р

US007683165B2

(12) United States Patent
McSwiggen et al.

(10) Patent No.: US 7,683,165 B2
(45) Date of Patent: Mar. 23, 2010

(54) RNA INTERFERENCE MEDIATED INHIBITION OF INTERLEUKIN AND INTERLEUKIN RECEPTOR GENE EXPRESSION USING SHORT INTERFERING NUCLEIC ACID (SINA)

(75) Inventors: James McSwiggen, Boulder, CO (US); Leonid Beigelman, Brisbane, CA (US)

(73) Assignee: Sirna Therapeutics, Inc., San Francisco, CA (US)

( * ) Notice: Subject to any disclaimer, the term of this patent is extended or adjusted under 35 U.S.C. 154(b) by 0 days.

(21) Appl. No.: 12/203,707
(22) Filed: Sep. 3, 2008
(65) Prior Publication Data
US 2009/0143324 A1 Jun. 4, 2009

Related U.S. Application Data

(63) Continuation of application No. 10/863,973, filed on Jun. 9, 2004, now abandoned, which is a continuation-in-part of application No. PCT/US03/04566, filed on Feb. 14, 2003, now abandoned, and a continuation-in-part of application No. PCT/US2004/016390, filed on May 24, 2004, which is a continuation-in-part of application No. 10/826,966, filed on Apr. 16, 2004, now abandoned, which is a continuation-in-part of application No. 10/757,803, filed on Jan. 14, 2004, which is a continuation-in-part of application No. 10/720,448, filed on Nov. 24, 2003, which is a continuation-in-part of application No. 10/693,059, filed on Oct. 23, 2003, which is a continuation-in-part of application No. 10/444,853, filed on May 23, 2003, which is a continuation-in-part of application No. PCT/US03/05346, filed on Feb. 20, 2003, and a continuation-in-part of application No. PCT/US03/05028, filed on Feb. 20, 2003.

(60) Provisional application No. 60/358,580, filed on Feb. 20, 2002, provisional application No. 60/363,124, filed on Mar. 11, 2002, provisional application No. 60/386,782, filed on Jun. 6, 2002, provisional application No. 60/406,784, filed on Aug. 29, 2002, provisional application No. 60/408,378, filed on Sep. 5, 2005, provisional application No. 60/409,293, filed on Sep. 9, 2002, provisional application No. 60/440,129, filed on Jan. 15, 2003.

(51) Int. Cl.
*C07H 21/02* (2006.01)
*C07H 21/04* (2006.01)
*A61K 31/70* (2006.01)
*A01N 43/04* (2006.01)
(52) U.S. Cl. .................... 536/24.5; 536/231; 536/24.3; 536/24.33; 514/44
(58) Field of Classification Search ................. 536/23.1, 536/24.3, 24.33, 24.5
See application file for complete search history.

(56) References Cited

U.S. PATENT DOCUMENTS 5,998,203 A 12/1999 Matulic-Adamic et al.
(Continued)

FOREIGN PATENT DOCUMENTS

WO WO-94/01550 A1 1/1994
(Continued)

OTHER PUBLICATIONS

Elbashir et al. (The EMBO Journal, vol. 20, No. 23, pp. 6877-6888, 2001).*
(Continued)

*Primary Examiner*—Sean McGarry
*Assistant Examiner*—Terra Cotta Gibbs
(74) *Attorney, Agent, or Firm*—Elaine C. Stracker

(57) ABSTRACT

This invention relates to compounds, compositions, and methods useful for modulating interleukin and/or interleukin receptor gene expression using short interfering nucleic acid (siNA) molecules. This invention also relates to compounds, compositions, and methods useful for modulating the expression and activity of other genes involved in pathways of interleukin and/or interleukin receptor gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of interleukin and/or interleukin receptor genes.

19 Claims, 25 Drawing Sheets

U.S. PATENT DOCUMENTS

| | | | |
|---|---|---|---|
| 5,998,206 A | 12/1999 | Cowsert | |
| 2005/0020521 A1 | 1/2005 | Rana | |
| 2005/0143333 A1* | 6/2005 | Richards et al. | 514/44 |

FOREIGN PATENT DOCUMENTS

| | | |
|---|---|---|
| WO | WO-02/44321 A2 | 6/2002 |
| WO | WO-02/44321 A3 | 6/2002 |
| WO | WO-03/064626 A2 | 8/2003 |
| WO | WO-03/064626 A3 | 8/2003 |

OTHER PUBLICATIONS

Elbashir et al. "Analysis of Gene Function in Somatic Mammalian Cells Using Small Interfering RNAs," *Methods* 26(2):199-213 (Feb. 2002).

Elbashir et al. "Duplexes of 21-Nucleotide RNAs Mediate RNA Interference in Cultured Mammalian Cells," *Nature* 411(6836):494-498 (May 24, 2001).

Elbashir et al. "Functional Anatomy of siRNAs for Mediating Efficient RNAi in *Drosophila melanogaster* Embryo Lysate," *EMBO J.* 20(23):6877-6888 (Dec. 3, 2001).

Elbashir et al. "RNA Interference is Mediated by 21- and 22-Nucleotide RNAs," *Genes Dev.* 15(2):188-200 (Jan. 15, 2001).

* cited by examiner

Figure 1
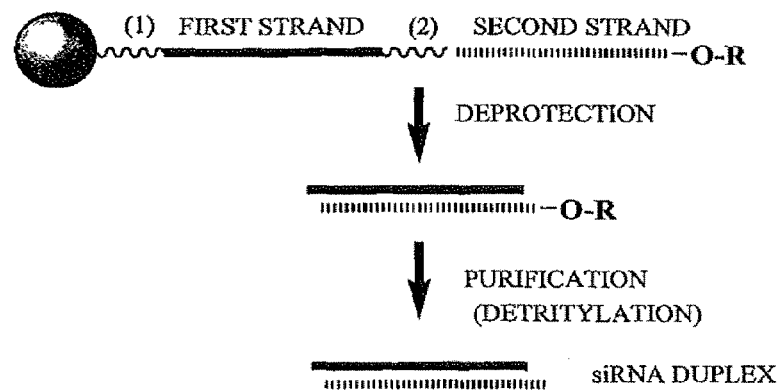
 = SOLID SUPPORT
R = TERMINAL PROTECTING GROUP
FOR EXAMPLE:
DIMETHOXYTRITYL (DMT)
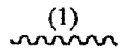 = CLEAVABLE LINKER
(FOR EXAMPLE: NUCLEOTIDE SUCCINATE OR INVERTED DEOXYABASIC SUCCINATE)
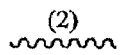 = CLEAVABLE LINKER
(FOR EXAMPLE: NUCLEOTIDE SUCCINATE OR INVERTED DEOXYABASIC SUCCINATE)
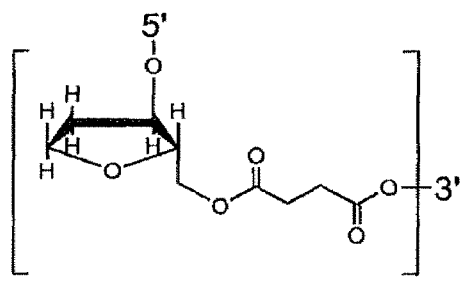
INVERTED DEOXYABASIC SUCCINATE LINKAGE
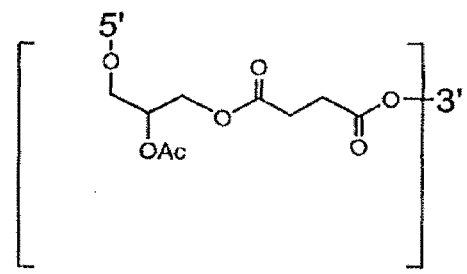
GLYCERYL SUCCINATE LINKAGE Figure 9: Target site Selection using siRNA

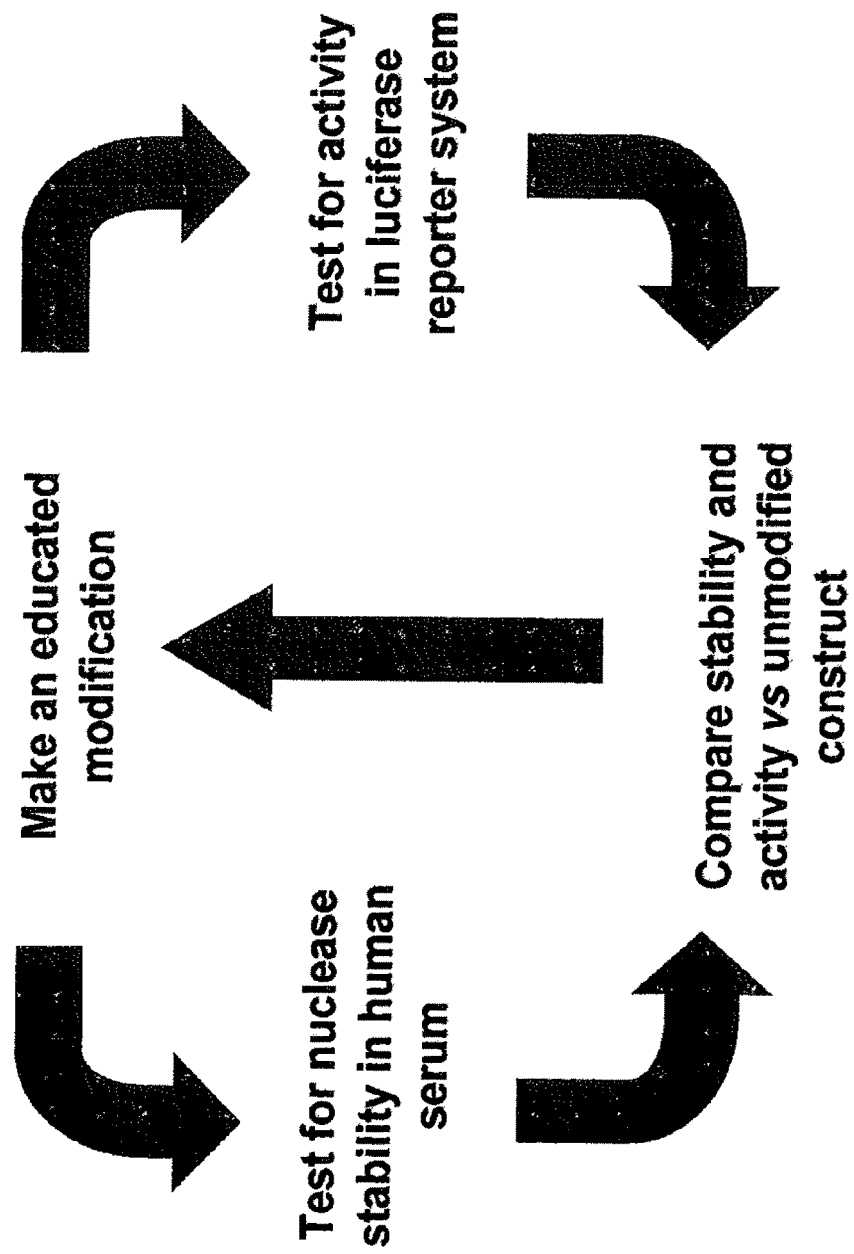
Figure 11: Modification Strategy

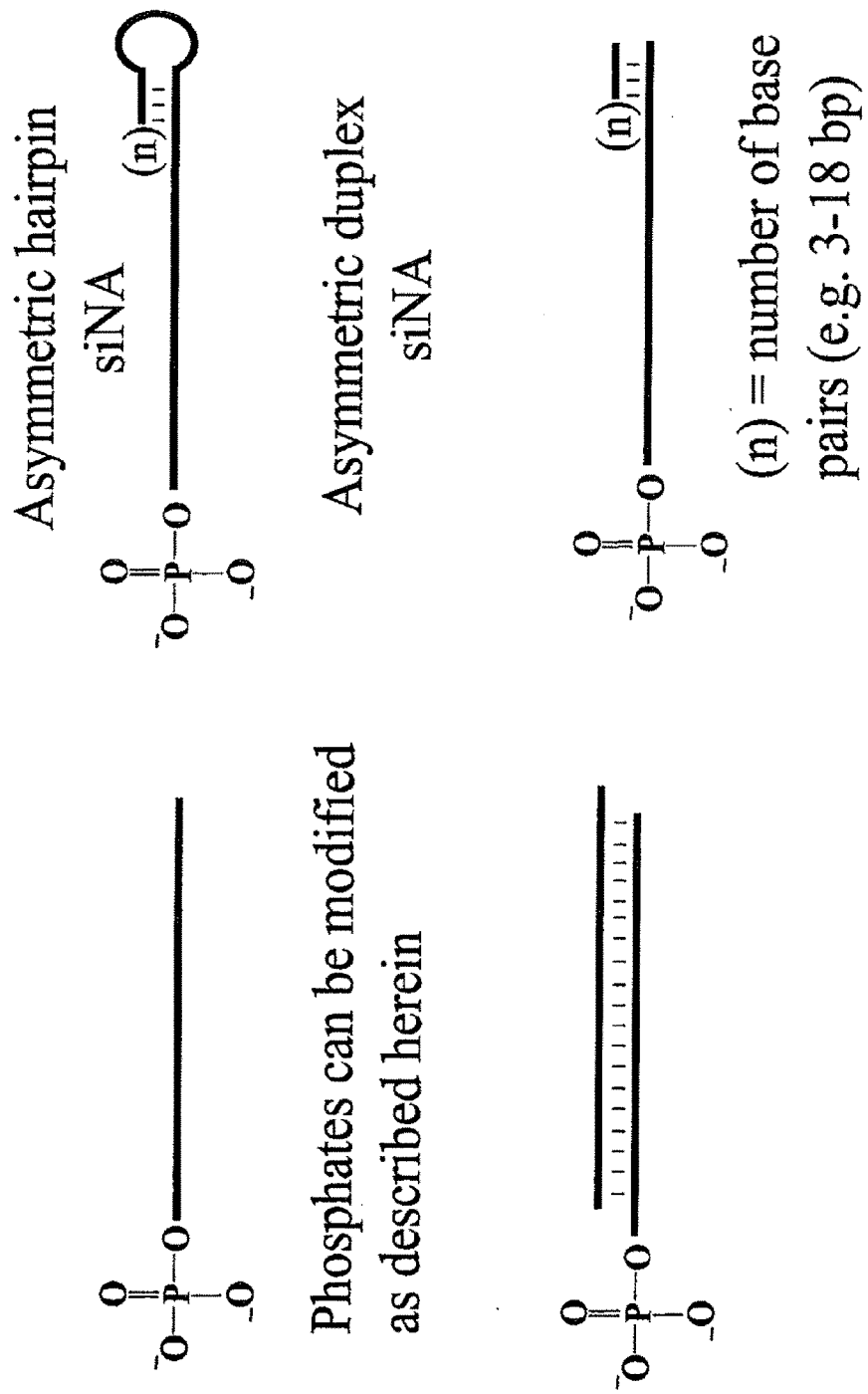
Figure 12: Phosphorylated siNA constructs

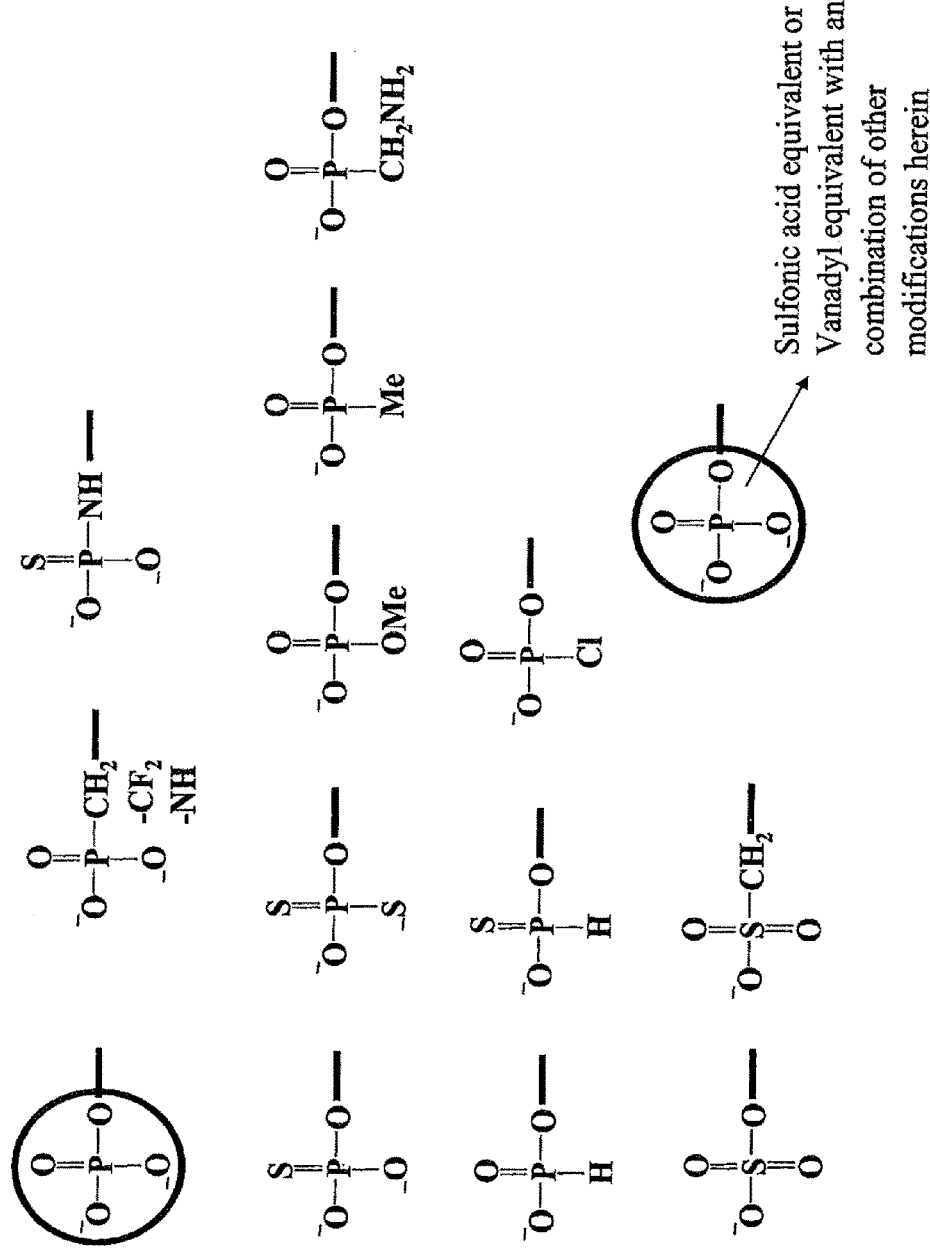
*Figure 13: 5'-phosphate modifications*

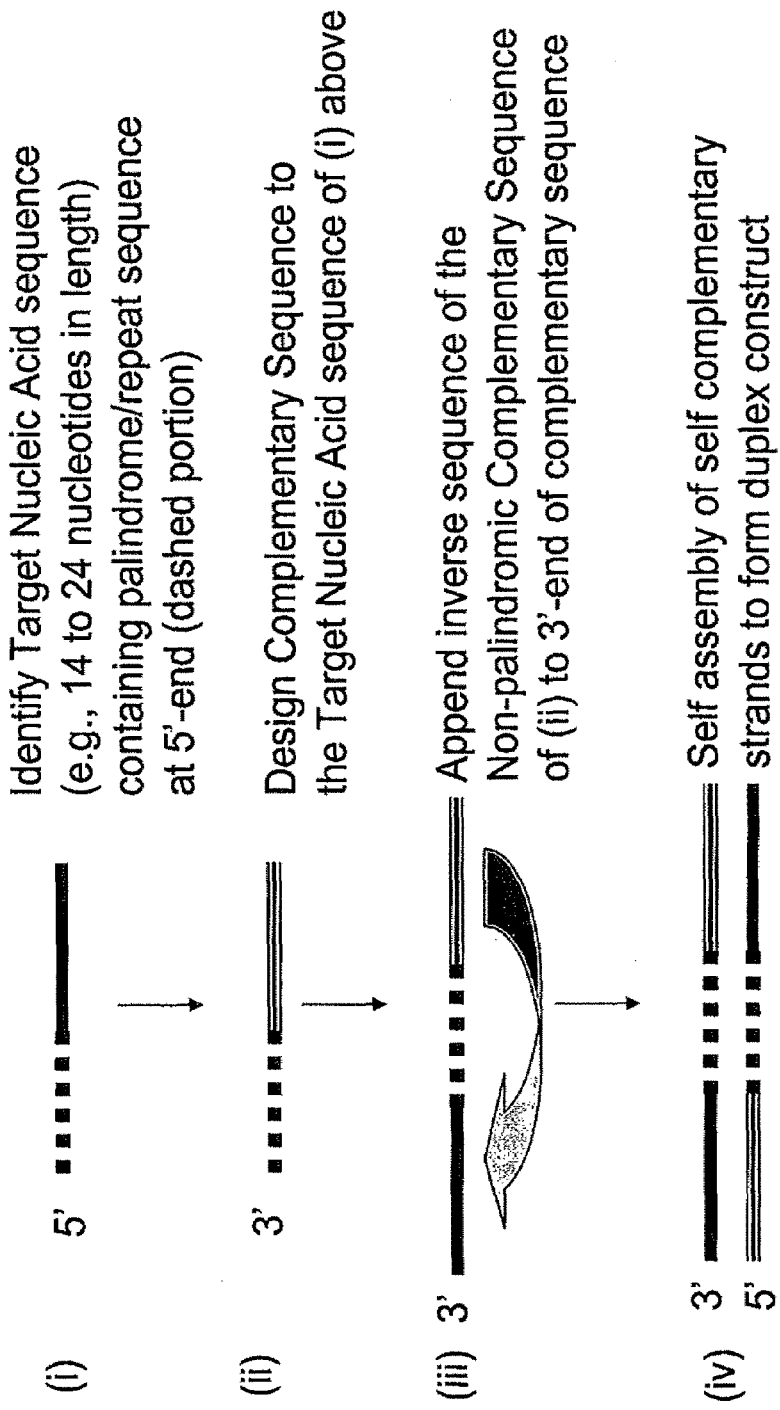
Figure 14A: Duplex forming oligonucleotide constructs that utilize palindrome or repeat sequences

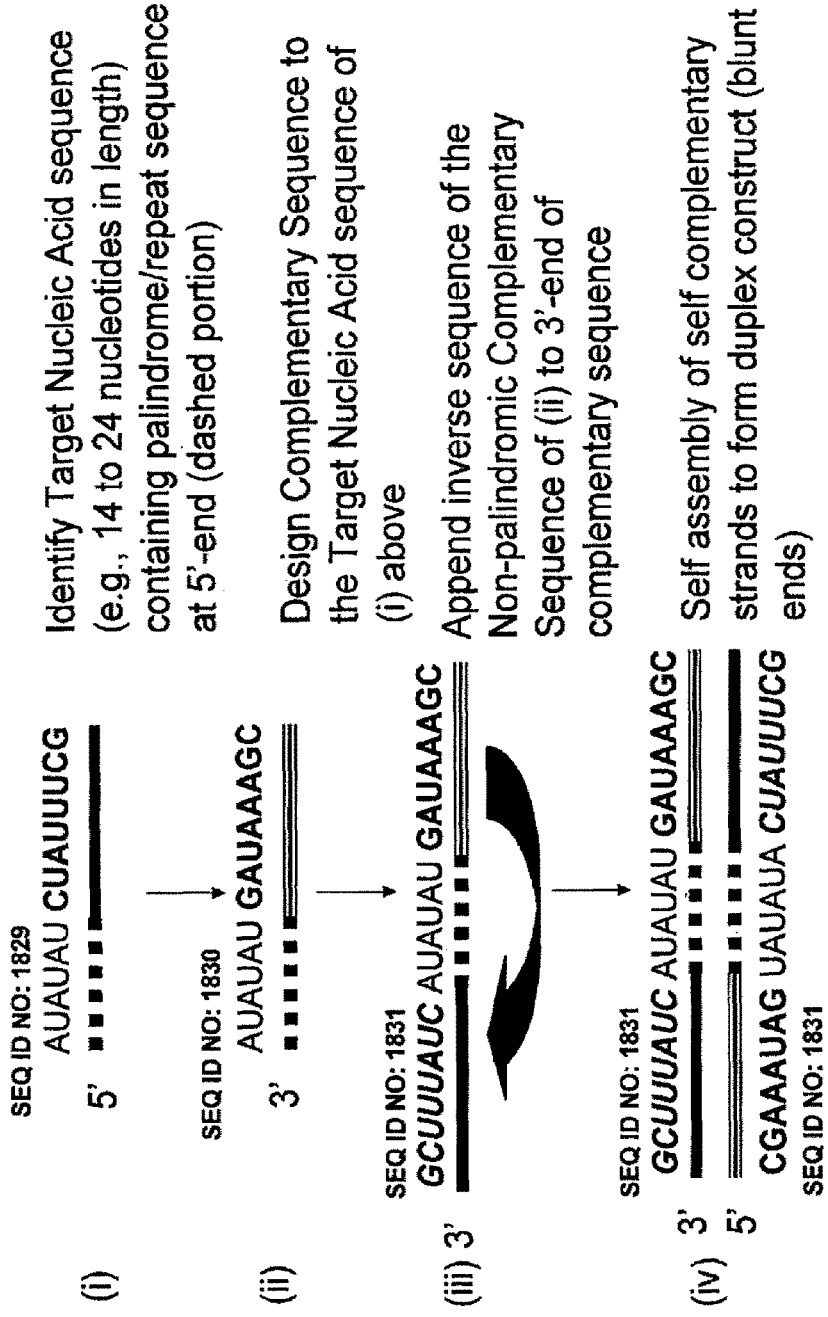
Figure 14B: Example of a duplex forming oligonucleotide sequence that utilizes a palindrome or repeat sequence

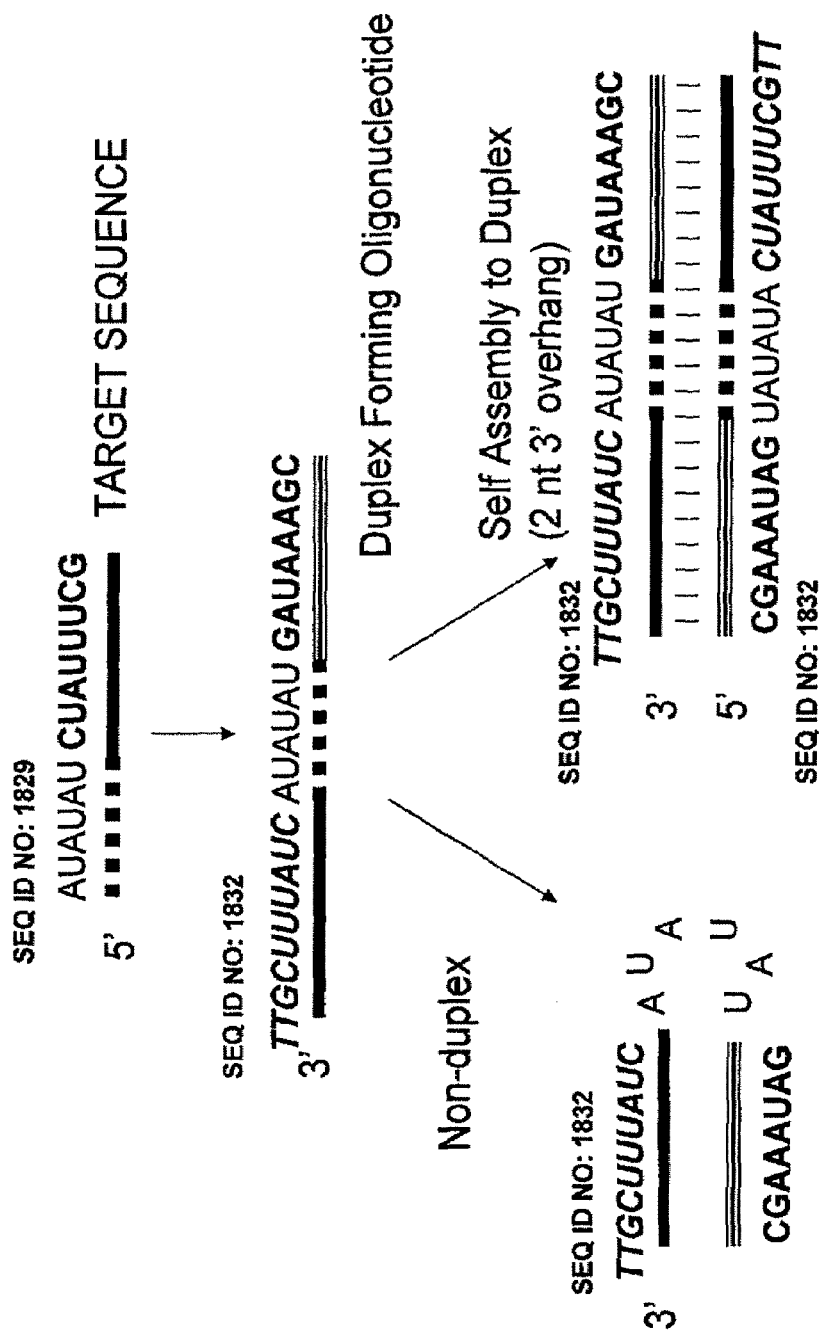
Figure 14C: Example of a duplex forming oligonucleotide sequence that utilizes a palindrome or repeat sequence, self assembly

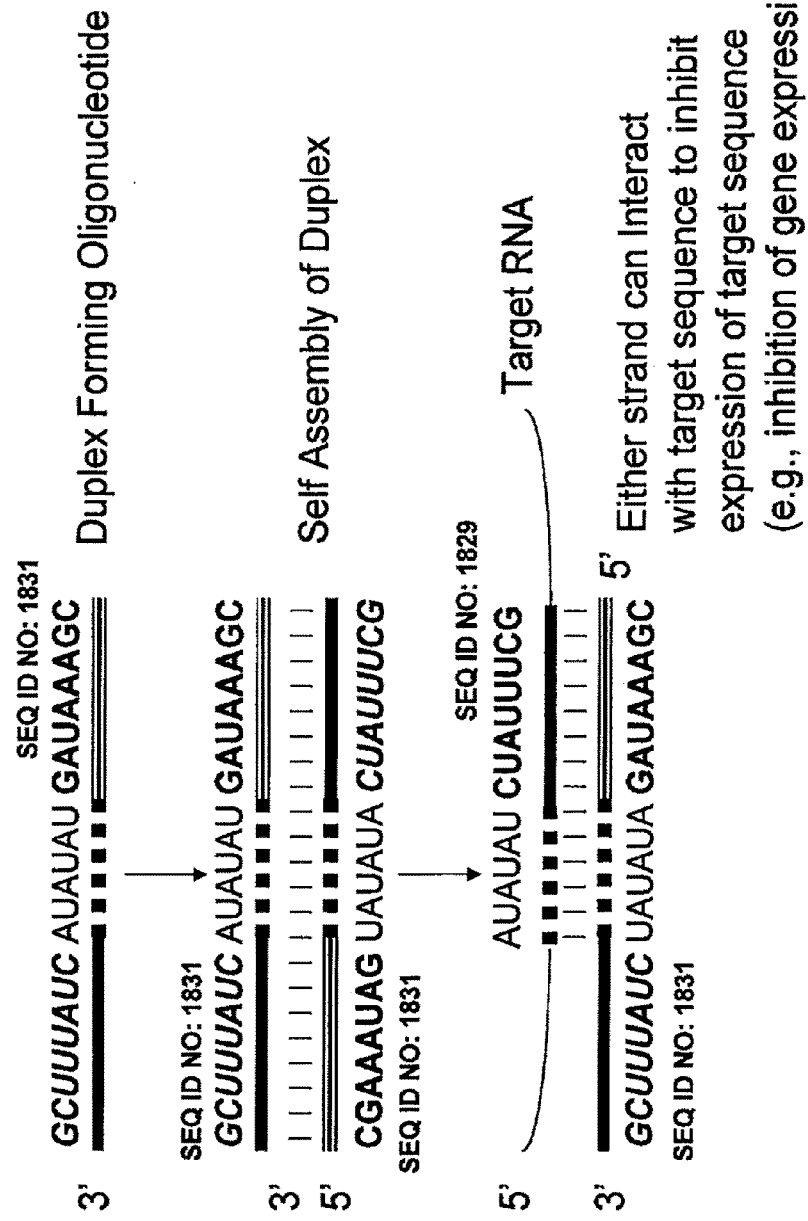
Figure 14D: Example of a duplex forming oligonucleotide sequence that utilizes a palindrome or repeat sequence, self assembly and inhibition of Target Sequence Expression

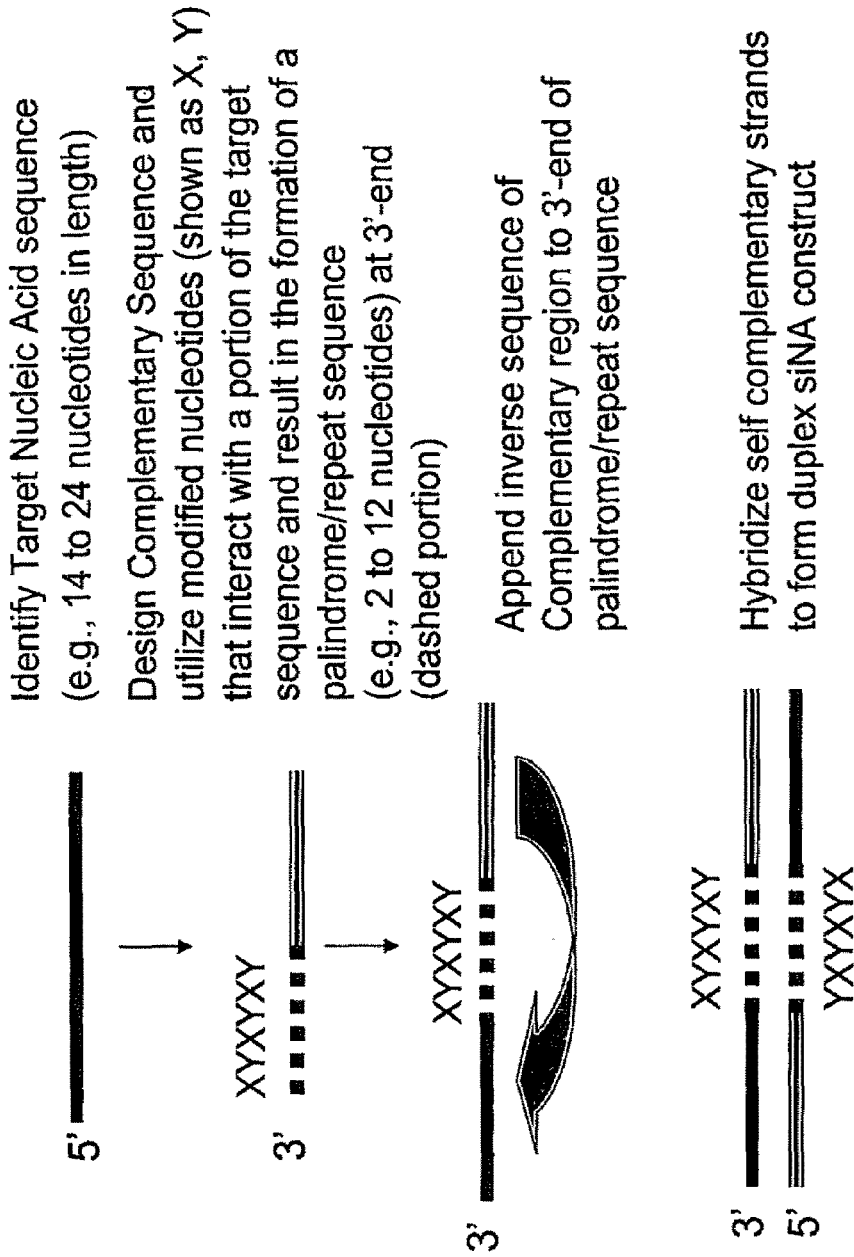
Figure 15: Duplex forming oligonucleotide constructs that utilize artificial palindrome or repeat sequences

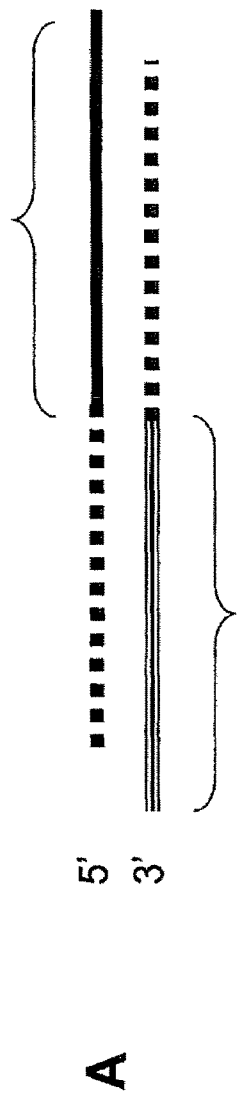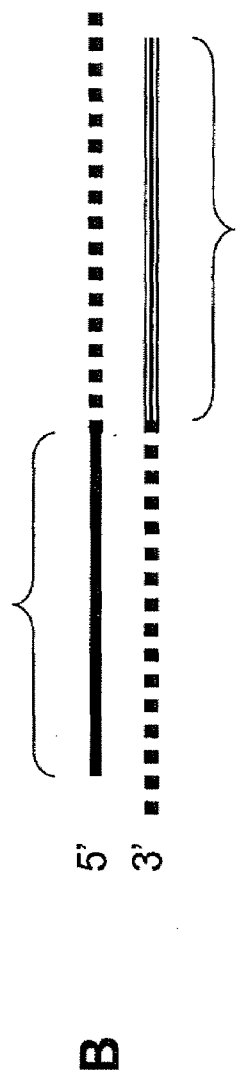
Figure 16: Examples of double stranded multifunctional siNA constructs with distinct complementary regions

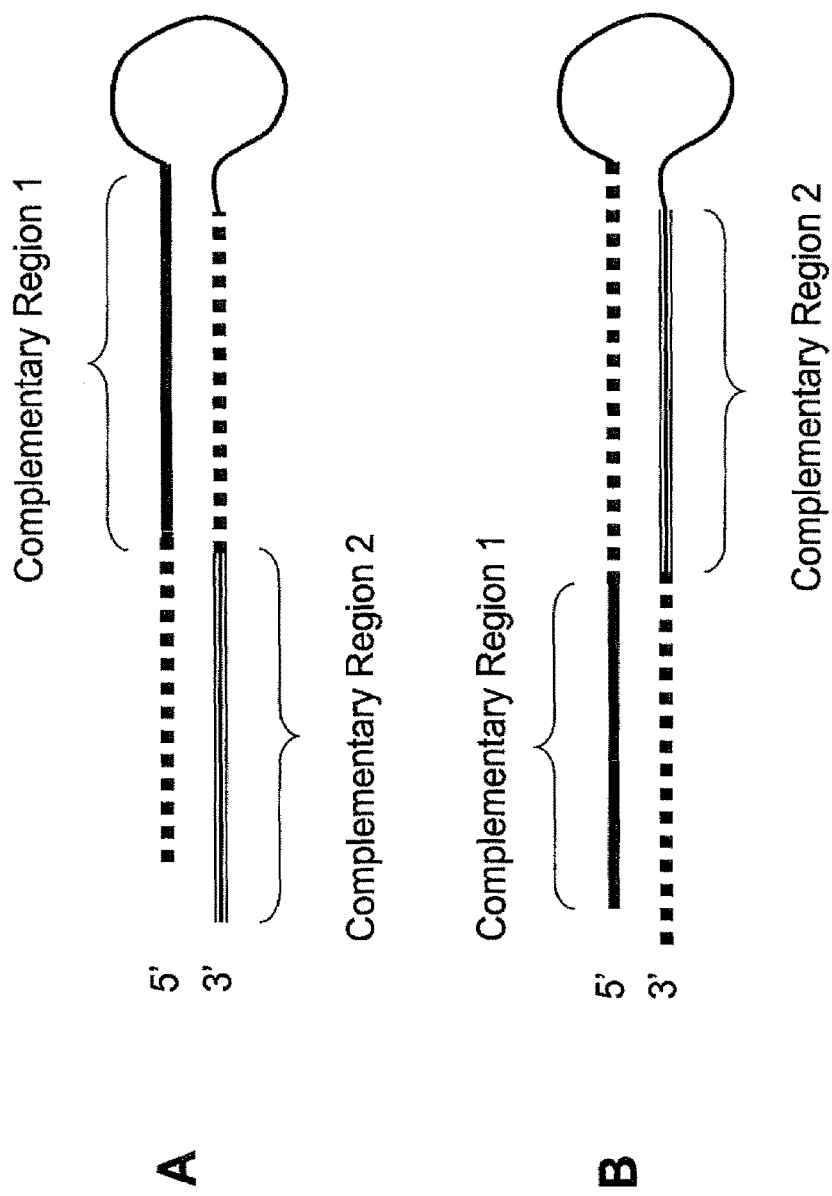
Figure 17: Examples of hairpin multifunctional siNA constructs with distinct complementary regions

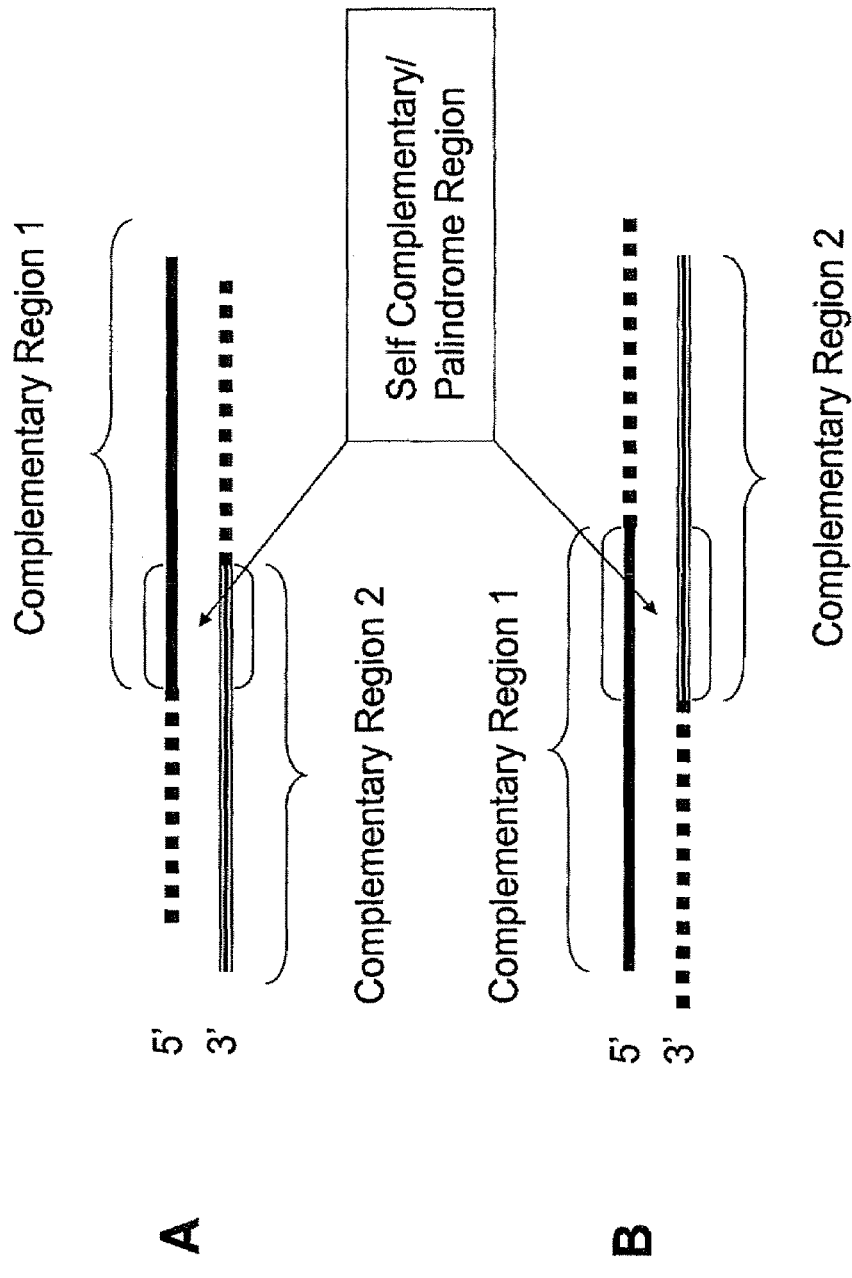
Figure 18: Examples of double stranded multifunctional siNA constructs with distinct complementary regions and a self complementary/palindrome region

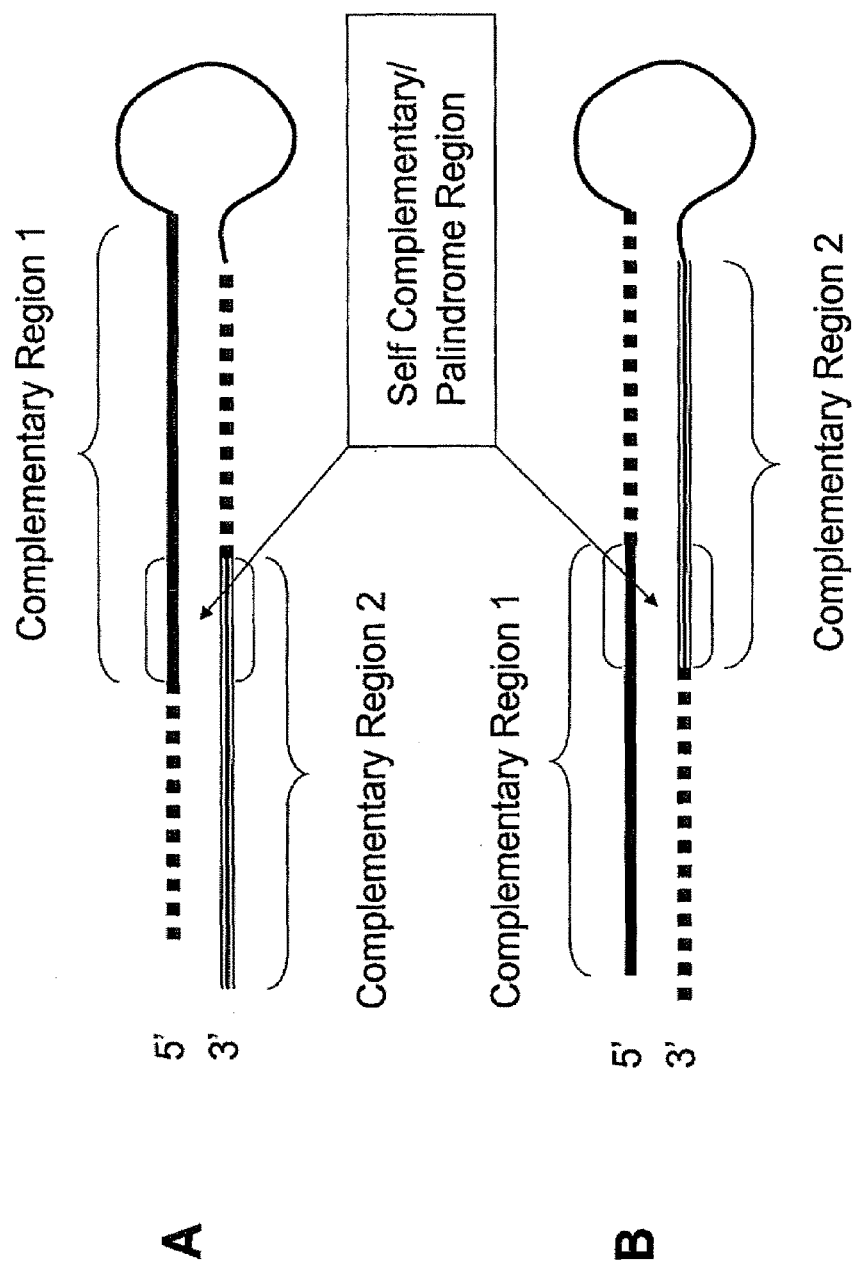
Figure 19: Examples of hairpin multifunctional siNA constructs with distinct complementary regions and a self complementary/palindrome region

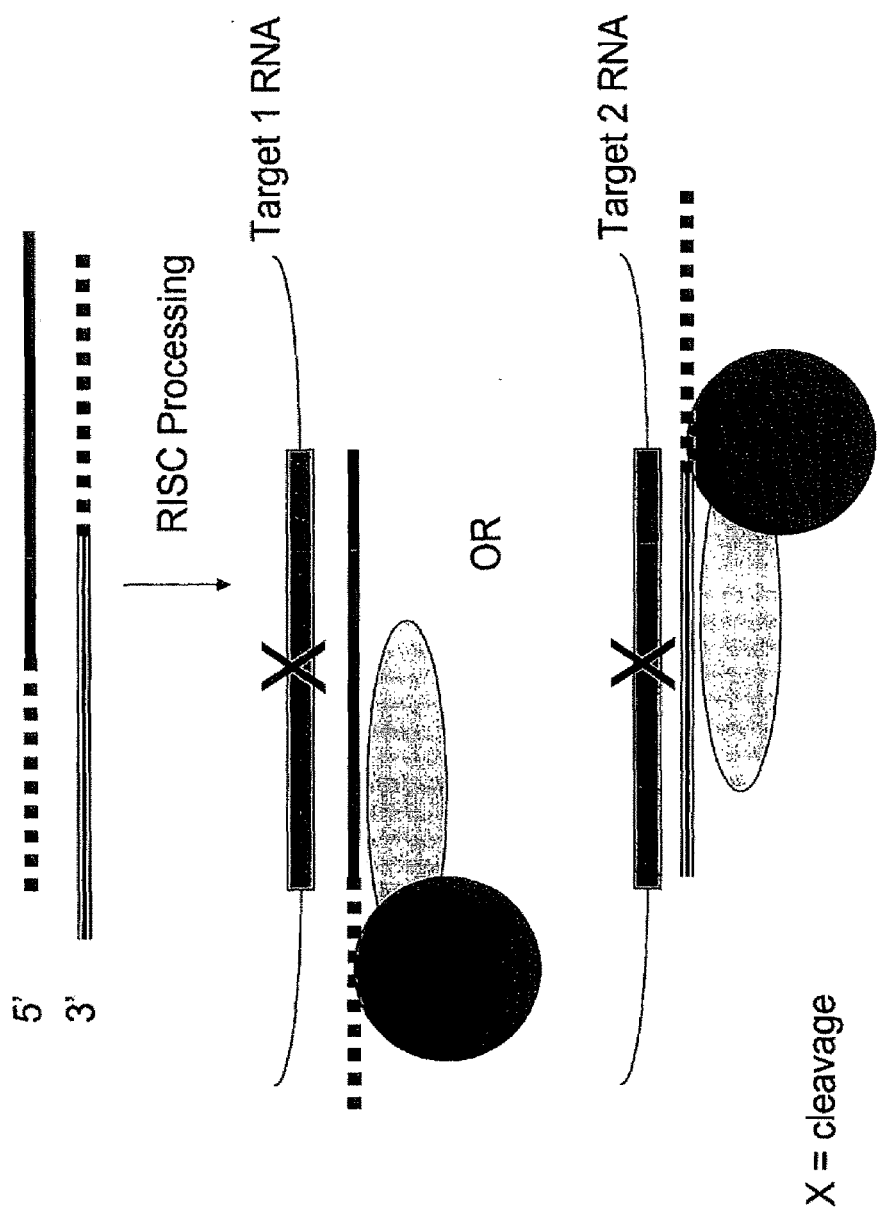
Figure 20: Example of multifunctional siNA targeting two separate Target nucleic acid sequences

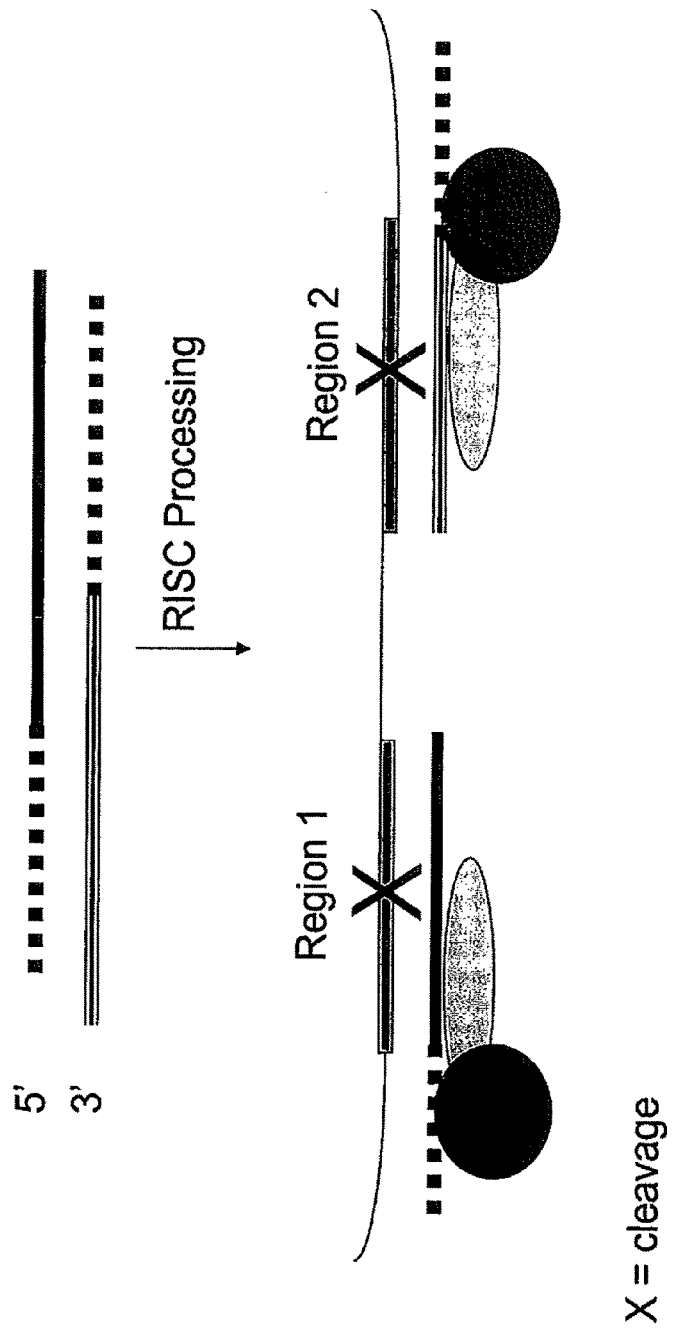
Figure 21: Example of multifunctional siNA targeting two regions within the same target nucleic acid sequence

RNA INTERFERENCE MEDIATED INHIBITION OF INTERLEUKIN AND INTERLEUKIN RECEPTOR GENE EXPRESSION USING SHORT INTERFERING NUCLEIC ACID (SINA)

This application is a continuation of U.S. patent application Ser. No. 10/863,973, filed on Jun. 9, 2004 (now abandoned), which is a continuation-in-part of International Patent Application No. PCT/US03/04566, filed Feb. 14, 2003, and parent U.S. patent application Ser. No. 10/863,973 (now abandoned), is also a continuation-in-part of International Patent Application No. PCT/US04/16390, filed May 24, 2004, which is a continuation-in-part of U.S. patent application Ser. No. 10/826,966, filed Apr. 16, 2004 (now abandoned), which is continuation-in-part of U.S. patent application Ser. No. 10/757,803, filed Jan. 14, 2004, which is a continuation-in-part of U.S. patent application Ser. No. 10/720,448, filed Nov. 24, 2003, which is a continuation-in-part of U.S. patent application Ser. No. 10/693,059, filed Oct. 23, 2003, which is a continuation-in-part of U.S. patent application Ser. No. 10/444,853, filed May 23, 2003, which is a continuation-in-part of International Patent Application No. PCT/US03/05346, filed Feb. 20, 2003, and a continuation-in-part of International Patent Application No. PCT/US03/05028, filed Feb. 20, 2003, both of which claim the benefit of U.S. Provisional Application No. 60/358,580, filed Feb. 20, 2002 (now abandoned), U.S. Provisional Application No. 60/363,124, filed Mar. 11, 2002 (now abandoned), U.S. Provisional Application No. 60/386,782, filed Jun. 6, 2002 (now abandoned), U.S. Provisional Application No. 60/406,784, filed Aug. 29, 2002 (now abandoned), U.S. Provisional Application No. 60/408,378, filed Sep. 5, 2002 (now abandoned), U.S. Provisional Application No. 60/409,293, filed Sep. 9, 2002 (now abandoned), and U.S. Provisional Application No. 60/440,129, filed Jan. 15, 2003 (now abandoned). The instant application claims the benefit of all the listed applications, which are hereby incorporated by reference herein in their entireties, including the drawings.

SEQUENCE LISTING

The sequence listing submitted via EFS, in compliance with 37 CFR §1.52(e)(5), is incorporated herein by reference. The sequence listing text file submitted via EFS contains the file "SequenceListing17USCNT", created on Sep. 3, 2008, which is 483,552 bytes in size.

FIELD OF THE INVENTION

The present invention relates to compounds, compositions, and methods for the study, diagnosis, and treatment of traits, diseases and conditions that respond to the modulation of interleukin gene expression and/or activity, such as IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, and IL-27 genes and genes encoding interleukin receptors of IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, and IL-27 genes. The present invention is also directed to compounds, compositions, and methods relating to traits, diseases and conditions that respond to the modulation of expression and/or activity of genes involved in interleukin gene expression pathways or other cellular processes that mediate the maintenance or development of such traits, diseases and conditions. Specifically, the invention relates to small nucleic acid molecules, such as short interfering nucleic acid (siNA), short interfering RNA (siRNA), double-stranded RNA (dsRNA), micro-RNA (miRNA), and short hairpin RNA (shRNA) molecules capable of mediating RNA interference (RNAi) against interleukin gene expression. Such small nucleic acid molecules are useful, for example, in providing compositions for treatment or prevention of traits, diseases and conditions that can respond to modulation of interleukin gene expression in a subject, such as inflammatory, respiratory, pulmonary, autoimmune, cardiovascular, neurodegenerative, and/or proliferative and cancerous diseases, traits, or conditions.

BACKGROUND OF THE INVENTION

The following is a discussion of relevant art pertaining to RNAi. The discussion is provided only for understanding of the invention that follows. The summary is not an admission that any of the work described below is prior art to the claimed invention.

RNA interference refers to the process of sequence-specific post-transcriptional gene silencing in animals mediated by short interfering RNAs (siRNAs) (Zamore et al., 2000, *Cell*, 101, 25-33; Fire et al., 1998, *Nature*, 391, 806; Hamilton et al., 1999, *Science*, 286, 950-951; Lin et al., 1999, *Nature*, 402, 128-129; Sharp, 1999, *Genes & Dev.*, 13:139-141; and Strauss, 1999, *Science*, 286, 886). The corresponding process in plants (Heifetz et al., International PCT Publication No. WO 99/61631) is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla (Fire et al., 1999, *Trends Genet.*, 15, 358). Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA. The presence of dsRNA in cells triggers the RNAi response through a mechanism that has yet to be fully characterized. This mechanism appears to be different from other known mechanisms involving double-stranded RNA-specific ribonucleases, such as the interferon response that results from dsRNA-mediated activation of protein kinase PKR and 2',5'-oligoadenylate synthetase resulting in non-specific cleavage of mRNA by ribonuclease L (see for example U.S. Pat. Nos. 6,107,094; 5,898,031; Clemens et al., 1997, *J. Interferon & Cytokine Res.*, 17, 503-524; Adah et al., 2001, *Curr. Med. Chem.*, 8, 1189).

The presence of long dsRNAs in cells stimulates the activity of a ribonuclease III enzyme referred to as dicer (Bass, 2000, *Cell*, 101, 235; Zamore et al., 2000, *Cell*, 101, 25-33; Hammond et al., 2000, *Nature*, 404, 293). Dicer is involved in the processing of the dsRNA into short pieces of dsRNA known as short interfering RNAs (siRNAs) (Zamore et al., 2000, *Cell*, 101, 25-33; Bass, 2000, *Cell*, 101, 235; Berstein et al., 2001, *Nature*, 409, 363). Short interfering RNAs derived from dicer activity are typically about 21 to about 23 nucleotides in length and comprise about 19 base pair duplexes (Zamore et al., 2000, *Cell*, 101, 25-33; Elbashir et al., 2001, *Genes Dev.*, 15, 188). Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex (Elbashir et al., 2001, *Genes Dev.*, 15, 188).

RNAi has been studied in a variety of systems. Fire et al., 1998, *Nature*, 391, 806, were the first to observe RNAi in *C. elegans*. Bahramian and Zarbl, 1999, *Molecular and Cellular Biology*, 19, 274-283 and Wianny and Goetz, 1999, *Nature Cell Biol.*, 2, 70, describe RNAi mediated by dsRNA in mammalian systems. Hammond et al., 2000, *Nature*, 404, 293, describe RNAi in *Drosophila* cells transfected with dsRNA. Elbashir et al., 2001, *Nature*, 411, 494 and Tuschl et al., International PCT Publication No. WO 01/75164, describe RNAi induced by introduction of duplexes of synthetic 21-nucleotide RNAs in cultured mammalian cells including human embryonic kidney and HeLa cells. Recent work in *Drosophila* embryonic lysates (Elbashir et al., 2001, *EMBO J.*, 20, 6877 and Tuschl et al., International PCT Publication No. WO 01/75164) has revealed certain requirements for siRNA length, structure, chemical composition, and sequence that are essential to mediate efficient RNAi activity. These studies have shown that 21-nucleotide siRNA duplexes are most active when containing 3'-terminal dinucleotide overhangs. Furthermore, complete substitution of one or both siRNA strands with 2'-deoxy (2'-H) or 2'-O-methyl nucleotides abolishes RNAi activity, whereas substitution of the 3'-terminal siRNA overhang nucleotides with 2'-deoxy nucleotides (2'-H) was shown to be tolerated. Single mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end of the guide sequence (Elbashir et al., 2001, *EMBO J.*, 20, 6877). Other studies have indicated that a 5'-phosphate on the target-complementary strand of an siRNA duplex is required for siRNA activity and that ATP is utilized to maintain the 5'-phosphate moiety on the siRNA (Nykanen et al., 2001, *Cell*, 107, 309).

Studies have shown that replacing the 3'-terminal nucleotide overhanging segments of a 21-mer siRNA duplex having two-nucleotide 3'-overhangs with deoxyribonucleotides does not have an adverse effect on RNAi activity. Replacing up to four nucleotides on each end of the siRNA with deoxyribonucleotides has been reported to be well tolerated, whereas complete substitution with deoxyribonucleotides results in no RNAi activity (Elbashir et al., 2001, *EMBO J.*, 20, 6877 and Tuschl et al., International PCT Publication No. WO 01/75164). In addition, Elbashir et al., supra, also report that substitution of siRNA with 2'-O-methyl nucleotides completely abolishes RNAi activity. Li et al., International PCT Publication No. WO 00/44914, and Beach et al., International PCT Publication No. WO 01/68836 preliminarily suggest that siRNA may include modifications to either the phosphate-sugar backbone or the nucleoside to include at least one of a nitrogen or sulfur heteroatom, however, neither application postulates to what extent such modifications would be tolerated in siRNA molecules, nor provides any further guidance or examples of such modified siRNA. Kreutzer et al., Canadian Patent Application No. 2,359,180, also describe certain chemical modifications for use in dsRNA constructs in order to counteract activation of double-stranded RNA-dependent protein kinase PKR, specifically 2'-amino or 2'-O-methyl nucleotides, and nucleotides containing a 2'-O or 4'-C methylene bridge. However, Kreutzer et al. similarly fails to provide examples or guidance as to what extent these modifications would be tolerated in dsRNA molecules.

Parrish et al., 2000, *Molecular Cell*, 6, 1077-1087, tested certain chemical modifications targeting the unc-22 gene in *C. elegans* using long (>25 nt) siRNA transcripts. The authors describe the introduction of thiophosphate residues into these siRNA transcripts by incorporating thiophosphate nucleotide analogs with T7 and T3 RNA polymerase and observed that RNAs with two phosphorothioate modified bases also had substantial decreases in effectiveness as RNAi. Further, Parrish et al. reported that phosphorothioate modification of more than two residues greatly destabilized the RNAs in vitro such that interference activities could not be assayed. Id. at 1081. The authors also tested certain modifications at the 2'-position of the nucleotide sugar in the long siRNA transcripts and found that substituting deoxynucleotides for ribonucleotides produced a substantial decrease in interference activity, especially in the case of Uridine to Thymidine and/or Cytidine to deoxy-Cytidine substitutions. Id. In addition, the authors tested certain base modifications, including substituting, in sense and antisense strands of the siRNA, 4-thiouracil, 5-bromouracil, 5-iodouracil, and 3-(aminoallyl)uracil for uracil, and inosine for guanosine. Whereas 4-thiouracil and 5-bromouracil substitution appeared to be tolerated, Parrish reported that inosine produced a substantial decrease in interference activity when incorporated in either strand. Parrish also reported that incorporation of 5-iodouracil and 3-(aminoallyl)uracil in the antisense strand resulted in a substantial decrease in RNAi activity as well.

The use of longer dsRNA has been described. For example, Beach et al., International PCT Publication No. WO 01/68836, describes specific methods for attenuating gene expression using endogenously-derived dsRNA. Tuschl et al., International PCT Publication No. WO 01/75164, describe a *Drosophila* in vitro RNAi system and the use of specific siRNA molecules for certain functional genomic and certain therapeutic applications; although Tuschl, 2001, *Chem. Biochem.*, 2, 239-245, doubts that RNAi can be used to cure genetic diseases or viral infection due to the danger of activating interferon response. Li et al., International PCT Publication No. WO 00/44914, describe the use of specific long (141 bp-488 bp) enzymatically synthesized or vector expressed dsRNAs for attenuating the expression of certain target genes. Zernicka-Goetz et al., International PCT Publication No. WO 01/36646, describe certain methods for inhibiting the expression of particular genes in mammalian cells using certain long (550 bp-714 bp), enzymatically synthesized or vector expressed dsRNA molecules. Fire et al., International PCT Publication No. WO 99/32619, describe particular methods for introducing certain long dsRNA molecules into cells for use in inhibiting gene expression in nematodes. Plaetinck et al., International PCT Publication No. WO 00/01846, describe certain methods for identifying specific genes responsible for conferring a particular phenotype in a cell using specific long dsRNA molecules. Mello et al., International PCT Publication No. WO 01/29058, describe the identification of specific genes involved in dsRNA-mediated RNAi. Pachuck et al., International PCT Publication No. WO 00/63364, describe certain long (at least 200 nucleotide) dsRNA constructs. Deschamps Depaillette et al., International PCT Publication No. WO 99/07409, describe specific compositions consisting of particular dsRNA molecules combined with certain anti-viral agents. Waterhouse et al., International PCT Publication No. 99/53050 and 1998, *PNAS*, 95, 13959-13964, describe certain methods for decreasing the phenotypic expression of a nucleic acid in plant cells using certain dsRNAs. Driscoll et al., International PCT Publication No. WO 01/49844, describe specific DNA expression constructs for use in facilitating gene silencing in targeted organisms.

Others have reported on various RNAi and gene-silencing systems. For example, Parrish et al., 2000, *Molecular Cell*, 6, 1077-1087, describe specific chemically-modified dsRNA constructs targeting the unc-22 gene of *C. elegans*. Grossniklaus, International PCT Publication No. WO 01/38551, describes certain methods for regulating polycomb gene expression in plants using certain dsRNAs. Churikov et al., International PCT Publication No. WO 01/42443, describe certain methods for modifying genetic characteristics of an organism using certain dsRNAs. Cogoni et al., International PCT Publication No. WO 01/53475, describe certain methods for isolating a *Neurospora* silencing gene and uses thereof. Reed et al., International PCT Publication No. WO 01/68836, describe certain methods for gene silencing in plants. Honer et al., International PCT Publication No. WO 01/70944, describe certain methods of drug screening using transgenic nematodes as Parkinson's Disease models using certain dsRNAs. Deak et al., International PCT Publication No. WO 01/72774, describe certain *Drosophila*-derived gene products that may be related to RNAi in *Drosophila*. Arndt et al., International PCT Publication No. WO 01/92513 describe certain methods for mediating gene suppression by using factors that enhance RNAi. Tuschl et al., International PCT Publication No. WO 02/44321, describe certain synthetic siRNA constructs. Pachuk et al., International PCT Publication No. WO 00/63364, and Satishchandran et al., International PCT Publication No. WO 01/04313, describe certain methods and compositions for inhibiting the function of certain polynucleotide sequences using certain long (over 250 bp), vector expressed dsRNAs. Echeverri et al., International PCT Publication No. WO 02/38805, describe certain *C. elegans* genes identified via RNAi. Kreutzer et al., International PCT Publications Nos. WO 02/055692, WO 02/055693, and EP 1144623 B1 describes certain methods for inhibiting gene expression using dsRNA. Graham et al., International PCT Publications Nos. WO 99/49029 and WO 01/70949, and AU 4037501 describe certain vector expressed siRNA molecules. Fire et al., U.S. Pat. No. 6,506,559, describe certain methods for inhibiting gene expression in vitro using certain long dsRNA (299 bp-1033 bp) constructs that mediate RNAi. Martinez et al., 2002, *Cell*, 110, 563-574, describe certain single-stranded siRNA constructs, including certain 5'-phosphorylated single-stranded siRNAs that mediate RNA interference in HeLa cells. Harborth et al., 2003, Antisense & Nucleic Acid Drug Development, 13, 83-105, describe certain chemically and structurally modified siRNA molecules. Chiu and Rana, 2003, RNA, 9, 1034-1048, describe certain chemically and structurally modified siRNA molecules. Woolf et al., International PCT Publication Nos. WO 03/064626 and WO 03/064625 describe certain chemically modified dsRNA constructs.

SUMMARY OF THE INVENTION

This invention relates to compounds, compositions, and methods useful for modulating interleukin and/or interleukin receptor gene expression using short interfering nucleic acid (siNA) molecules. This invention also relates to compounds, compositions, and methods useful for modulating the expression and activity of other genes involved in pathways of interleukin and/or interleukin receptor gene expression and/or activity by RNA interference (RNAi) using small nucleic acid molecules. In particular, the instant invention features small nucleic acid molecules, such as short interfering nucleic acid (siNA), short interfering RNA (siRNA), double-stranded RNA (dsRNA), micro-RNA (miRNA), and short hairpin RNA (shRNA) molecules and methods used to modulate the expression of interleukin and/or interleukin receptor genes.

An siNA of the invention can be unmodified or chemically-modified. An siNA of the instant invention can be chemically synthesized, expressed from a vector or enzymatically synthesized. The instant invention also features various chemically-modified synthetic short interfering nucleic acid (siNA) molecules capable of modulating interleukin and/or interleukin receptor gene expression or activity in cells by RNA interference (RNAi). The use of chemically-modified siNA improves various properties of native siNA molecules through increased resistance to nuclease degradation in vivo and/or through improved cellular uptake. Further, contrary to earlier published studies, siNA having multiple chemical modifications retains its RNAi activity. The siNA molecules of the instant invention provide useful reagents and methods for a variety of therapeutic, diagnostic, target validation, genomic discovery, genetic engineering, and pharmacogenomic applications.

In one embodiment, the invention features one or more siNA molecules and methods that independently or in combination modulate the expression of interleukin and/or interleukin receptor genes encoding proteins, such as proteins comprising interleukins (e.g., IL-1-IL-27) and interleukin receptors (e.g., IL-IR-1L-27R), such as genes encoding sequences comprising those sequences referred to by GenBank Accession Nos. shown in Table I, referred to herein generally as interleukin and/or interleukin receptor. The description below of the various aspects and embodiments of the invention is provided with reference to exemplary interleukin and interleukin receptor genes referred to herein as interleukin and/or interleukin receptor. However, the various aspects and embodiments are also directed to other interleukin and/or interleukin receptor genes, such as interleukin and/or interleukin receptor homolog genes, transcript variants, and polymorphisms (e.g., single nucleotide polymorphism, (SNPs)) associated with certain interleukin and/or interleukin receptor genes, for example genes associated with diseases, traits, or conditions described herein or otherwise known in the art. As such, the various aspects and embodiments are also directed to other genes that are involved in interleukin and/or interleukin receptor mediated pathways of signal transduction or gene expression. These additional genes can be analyzed for target sites using the methods described for interleukin and/or interleukin receptor genes herein. Thus, the modulation of other genes and the effects of such modulation of the other genes can be performed, determined, and measured as described herein.

In one embodiment, the invention features a double-stranded short interfering nucleic acid (siNA) molecule that down-regulates expression of a interleukin and/or interleukin receptor gene, wherein said siNA molecule comprises about 19 to about 21 base pairs.

In one embodiment, the invention features an siNA molecule that down-regulates expression of a interleukin and/or interleukin receptor gene, for example, wherein the interleukin and/or interleukin receptor gene comprises interleukin and/or interleukin receptor encoding sequence. In one embodiment, the invention features an siNA molecule that down-regulates expression of a interleukin and/or interleukin receptor gene, for example, wherein the interleukin and/or interleukin receptor gene comprises interleukin and/or interleukin receptor non-coding sequence or regulatory elements involved in interleukin and/or interleukin receptor gene expression.

In one embodiment, an siNA of the invention is used to inhibit the expression of interleukin and/or interleukin receptor genes or a interleukin and/or interleukin receptor gene family, wherein the genes or gene family sequences share sequence homology. Such homologous sequences can be identified as is known in the art, for example using sequence alignments. siNA molecules can be designed to target such homologous sequences, for example using perfectly complementary sequences or by incorporating non-canonical base pairs, for example mismatches and/or wobble base pairs, that can provide additional target sequences. In instances where mismatches are identified, non-canonical base pairs, for example mismatches and/or wobble bases, can be used to generate siNA molecules that target both more than one gene sequences. In a non-limiting example, non-canonical base pairs such as UU and CC base pairs are used to generate siNA molecules that are capable of targeting sequences for differing interleukin and/or interleukin receptor targets that share sequence homology (e.g., differing interleukin genes or differing allelic variants thereof). As such, one advantage of using siNAs of the invention is that a single siNA can be designed to include nucleic acid sequence that is complementary to the nucleotide sequence that is conserved between the homologous genes. In this approach, a single siNA can be used to inhibit expression of more than one interleukin and/or interleukin receptor gene instead of using more than one siNA molecule to target the different genes.

In one embodiment, the invention features an siNA molecule having RNAi activity against interleukin and/or interleukin receptor RNA, wherein the siNA molecule comprises a sequence complementary to any RNA having interleukin and/or interleukin receptor encoding sequence, such as those sequences having GenBank Accession Nos. shown in Table I. In another embodiment, the invention features an siNA molecule having RNAi activity against interleukin and/or interleukin receptor RNA, wherein the siNA molecule comprises a sequence complementary to an RNA having variant interleukin and/or interleukin receptor encoding sequence, for example other mutant interleukin and/or interleukin receptor genes not shown in Table I but known in the art to be associated with diseases, traits, or conditions described herein or otherwise known in the art. Chemical modifications as shown in Tables III and IV or otherwise described herein can be applied to any siNA construct of the invention. In another embodiment, an siNA molecule of the invention includes a nucleotide sequence that can interact with nucleotide sequence of a interleukin and/or interleukin receptor gene and thereby mediate silencing of interleukin and/or interleukin receptor gene expression, for example, wherein the siNA mediates regulation of interleukin and/or interleukin receptor gene expression by cellular processes that modulate the chromatin structure or methylation patterns of the interleukin and/or interleukin receptor gene and prevent transcription of the interleukin and/or interleukin receptor gene.

In one embodiment, siNA molecules of the invention are used to down regulate or inhibit the expression of interleukin and/or interleukin receptor proteins arising from interleukin and/or interleukin receptor haplotype polymorphisms that are associated with a disease or condition, (e.g., proliferative, inflammatory, autoimmune, respiratory, pulmonary, cardiovascular, neurodegenerative diseases). Analysis of interleukin and/or interleukin receptor genes, or interleukin and/or interleukin receptor protein or RNA levels can be used to identify subjects with such polymorphisms or those subjects who are at risk of developing traits, conditions, or diseases described herein. These subjects are amenable to treatment, for example, treatment with siNA molecules of the invention and any other composition useful in treating diseases related to interleukin and/or interleukin receptor gene expression. As such, analysis of interleukin and/or interleukin receptor protein or RNA levels can be used to determine treatment type and the course of therapy in treating a subject. Monitoring of interleukin and/or interleukin receptor protein or RNA levels can be used to predict treatment outcome and to determine the efficacy of compounds and compositions that modulate the level and/or activity of certain interleukin and/or interleukin receptor proteins associated with a trait, condition, or disease.

In one embodiment of the invention an siNA molecule comprises an antisense strand comprising a nucleotide sequence that is complementary to a nucleotide sequence or a portion thereof encoding a interleukin and/or interleukin receptor protein. The siNA further comprises a sense strand, wherein said sense strand comprises a nucleotide sequence of a interleukin and/or interleukin receptor gene or a portion thereof.

In another embodiment, the invention features an siNA molecule comprising a nucleotide sequence in the antisense region of the siNA molecule that is complementary to a nucleotide sequence or portion of sequence of a interleukin and/or interleukin receptor gene. In another embodiment, the invention features an siNA molecule comprising a region, for example, the antisense region of the siNA construct, complementary to a sequence comprising a interleukin and/or interleukin receptor gene sequence or a portion thereof.

In one embodiment, the antisense region of interleukin and/or interleukin receptor siNA constructs comprises a sequence complementary to sequence having any of SEQ ID NOs. 1-81, 163-213, 265-464, 665-735, 807-1029, or 1253-1260. In one embodiment, the antisense region of interleukin and/or interleukin receptor constructs comprises sequence having any of SEQ ID NOs. 82-162, 214-264, 465-664, 736-806, 1030-1252, 1319-1326, 1335-1342, 1351-1358, 1367-1374, 1383-1406, 1415-1422, 1431-1438, 1447-1454, 1463-1470, 1479-1502, 1511-1518, 1527-1534, 1543-1550, 1559-1566, 1575-1598, 1607-1614, 1623-1630, 1649-1656, 1665-1682, 1691-1714, 1723-1730, 1739-1746, 1755-1762, 1771-1778, 1787-1810, 1812, 1814, 1816, 1819, 1821, 1823, 1825, or 1828. In another embodiment, the sense region of interleukin and/or interleukin receptor constructs comprises sequence having any of SEQ ID NOs. 1-81, 163-213, 265-464, 665-735, 807-1029, 1253-1260, 1311-1318, 1327-1334, 1343-1350, 1359-1366, 1375-1382, 1269-1276, 1407-1414, 1423-1430, 1439-1446, 1455-1462, 1471-1478, 1277-1284, 1503-1510, 1519-1526, 1535-1542, 1551-1558, 1567-1574, 1285-1292, 1599-1606, 1615-1622, 1631-1648, 1657-1664, 1683-1690, 1303-1310, 1715-1722, 1731-1738, 1747-1754, 1763-1770, 1779-1786, 1811, 1813, 1815, 1817, 1818, 1820, 1822, 1824, 1826, or 1827.

In one embodiment, an siNA molecule of the invention comprises any of SEQ ID NOs. 1-1828. The sequences shown in SEQ ID NOs: 1-1828 are not limiting. An siNA molecule of the invention can comprise any contiguous interleukin and/or interleukin receptor sequence (e.g., about 19 to about 25, or about 19, 20, 21, 22, 23, 24, or 25 contiguous interleukin and/or interleukin receptor nucleotides).

In yet another embodiment, the invention features an siNA molecule comprising a sequence, for example, the antisense sequence of the siNA construct, complementary to a sequence or portion of sequence comprising sequence represented by GenBank Accession Nos. shown in Table I. Chemical modifications in Tables III and IV and described herein can be applied to any siNA construct of the invention.

In one embodiment of the invention an siNA molecule comprises an antisense strand having about 19 to about 29 (e.g., about 19, 20, 21, 22, 23, 24, 25, 26, 27, 28, or 29) nucleotides, wherein the antisense strand is complementary to a RNA sequence encoding a interleukin and/or interleukin receptor protein, and wherein said siNA further comprises a sense strand having about 19 to about 29 (e.g., about 19, 20, 21, 22, 23, 24, 25, 26, 27, 28, or 29) nucleotides, and wherein said sense strand and said antisense strand are distinct nucleotide sequences with at least about 19 complementary nucleotides.

In another embodiment of the invention an siNA molecule of the invention comprises an antisense region having about 19 to about 29 (e.g., about 19, 20, 21, 22, 23, 24, 25, 26, 27, 28, or 29) nucleotides, wherein the antisense region is complementary to a RNA sequence encoding a interleukin and/or interleukin receptor protein, and wherein said siNA further comprises a sense region having about 19 to about 29 (e.g., about 19, 20, 21, 22, 23, 24, 25, 26, 27, 28, or 29) nucleotides, wherein said sense region and said antisense region comprise a linear molecule with at least about 19 complementary nucleotides.

In one embodiment, an siNA molecule of the invention has RNAi activity that modulates expression of RNA encoded by a interleukin and/or interleukin receptor gene. Because interleukin and/or interleukin receptor genes can share some degree of sequence homology with each other, siNA molecules can be designed to target a class of interleukin and/or interleukin receptor genes or alternately specific interleukin and/or interleukin receptor genes (e.g., polymorphic variants) by selecting sequences that are either shared amongst different interleukin and/or interleukin receptor targets or alternatively that are unique for a specific interleukin and/or interleukin receptor target. Therefore, in one embodiment, the siNA molecule can be designed to target conserved regions of interleukin and/or interleukin receptor RNA sequences having homology among several interleukin and/or interleukin receptor gene variants so as to target a class of interleukin and/or interleukin receptor genes with one siNA molecule. Accordingly, in one embodiment, the siNA molecule of the invention modulates the expression of one or both interleukin and/or interleukin receptor alleles in a subject. In another embodiment, the siNA molecule can be designed to target a sequence that is unique to a specific interleukin and/or interleukin receptor RNA sequence (e.g., a single interleukin and/or interleukin receptor allele or interleukin and/or interleukin receptor single nucleotide polymorphism (SNP)) due to the high degree of specificity that the siNA molecule requires to mediate RNAi activity.

In one embodiment, nucleic acid molecules of the invention that act as mediators of the RNA interference gene silencing response are double-stranded nucleic acid molecules. In another embodiment, the siNA molecules of the invention consist of duplex nucleic acid molecules containing about 19 base pairs between oligonucleotides comprising about 19 to about 25 (e.g., about 19, 20, 21, 22, 23, 24, or 25) nucleotides. In yet another embodiment, siNA molecules of the invention comprise duplex nucleic acid molecules with overhanging ends of about 1 to about 3 (e.g., about 1, 2, or 3) nucleotides, for example, about 21-nucleotide duplexes with about 19 base pairs and 3'-terminal mononucleotide, dinucleotide, or trinucleotide overhangs.

In one embodiment, the invention features one or more chemically-modified siNA constructs having specificity for interleukin and/or interleukin receptor expressing nucleic acid molecules, such as RNA encoding a interleukin and/or interleukin receptor protein. Non-limiting examples of such chemical modifications include without limitation phosphorothioate internucleotide linkages, 2'-deoxyribonucleotides, 2'-O-methyl ribonucleotides, 2'-deoxy-2'-fluoro ribonucleotides, "universal base" nucleotides, "acyclic" nucleotides, 5-C-methyl nucleotides, and terminal glyceryl and/or inverted deoxy abasic residue incorporation. These chemical modifications, when used in various siNA constructs, are shown to preserve RNAi activity in cells while at the same time, dramatically increasing the serum stability of these compounds. Furthermore, contrary to the data published by Parrish et al., supra, applicant demonstrates that multiple (greater than one) phosphorothioate substitutions are well-tolerated and confer substantial increases in serum stability for modified siNA constructs.

In one embodiment, an siNA molecule of the invention comprises modified nucleotides while maintaining the ability to mediate RNAi. The modified nucleotides can be used to improve in vitro or in vivo characteristics such as stability, activity, and/or bioavailability. For example, an siNA molecule of the invention can comprise modified nucleotides as a percentage of the total number of nucleotides present in the siNA molecule. As such, an siNA molecule of the invention can generally comprise about 5% to about 100% modified nucleotides (e.g., about 5%, 10%, 15%, 20%, 25%, 30%, 35%, 40%, 45%, 50%, 55%, 60%, 65%, 70%, 75%, 80%, 85%, 90%, 95% or 100% modified nucleotides). The actual percentage of modified nucleotides present in a given siNA molecule will depend on the total number of nucleotides present in the siNA. If the siNA molecule is single-stranded, the percent modification can be based upon the total number of nucleotides present in the single-stranded siNA molecules. Likewise, if the siNA molecule is double-stranded, the percent modification can be based upon the total number of nucleotides present in the sense strand, antisense strand, or both the sense and antisense strands.

One aspect of the invention features a double-stranded short interfering nucleic acid (siNA) molecule that down-regulates expression of a interleukin and/or interleukin receptor gene. In one embodiment, the double-stranded siNA molecule comprises one or more chemical modifications and each strand of the double-stranded siNA is about 21 nucleotides long. In one embodiment, the double-stranded siNA molecule does not contain any ribonucleotides. In another embodiment, the double-stranded siNA molecule comprises one or more ribonucleotides. In one embodiment, each strand of the double-stranded siNA molecule comprises about 19 to about 29 (e.g., about 19, 20, 21, 22, 23, 24, 25, 26, 27, 28, or 29) nucleotides, wherein each strand comprises about 19 nucleotides that are complementary to the nucleotides of the other strand. In one embodiment, one of the strands of the double-stranded siNA molecule comprises a nucleotide sequence that is complementary to a nucleotide sequence or a portion thereof of the interleukin and/or interleukin receptor gene, and the second strand of the double-stranded siNA molecule comprises a nucleotide sequence substantially similar to the nucleotide sequence of the interleukin and/or interleukin receptor gene or a portion thereof.

In another embodiment, the invention features a double-stranded short interfering nucleic acid (siNA) molecule that down-regulates expression of a interleukin and/or interleukin receptor gene comprising an antisense region, wherein the antisense region comprises a nucleotide sequence that is complementary to a nucleotide sequence of the interleukin and/or interleukin receptor gene or a portion thereof, and a sense region, wherein the sense region comprises a nucleotide sequence substantially similar to the nucleotide sequence of the interleukin and/or interleukin receptor gene or a portion thereof. In one embodiment, the antisense region and the sense region each comprise about 19 to about 23 (e.g. about 19, 20, 21, 22, or 23) nucleotides, wherein the antisense region comprises about 19 nucleotides that are complementary to nucleotides of the sense region.

In another embodiment, the invention features a double-stranded short interfering nucleic acid (siNA) molecule that down-regulates expression of a interleukin and/or interleukin receptor gene comprising a sense region and an antisense region, wherein the antisense region comprises a nucleotide sequence that is complementary to a nucleotide sequence of RNA encoded by the interleukin and/or interleukin receptor gene or a portion thereof and the sense region comprises a nucleotide sequence that is complementary to the antisense region.

In one embodiment, an siNA molecule of the invention comprises blunt ends, i.e., ends that do not include any overhanging nucleotides. For example, an siNA molecule comprising modifications described herein (e.g., comprising nucleotides having Formulae I-VII or siNA constructs comprising "Stab 00"-"Stab 25" (Table IV) or any combination thereof (see Table IV)) and/or any length described herein can comprise blunt ends or ends with no overhanging nucleotides.

In one embodiment, any siNA molecule of the invention can comprise one or more blunt ends, i.e. where a blunt end does not have any overhanging nucleotides. In one embodiment, the blunt ended siNA molecule has a number of base pairs equal to the number of nucleotides present in each strand of the siNA molecule. In another embodiment, the siNA molecule comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In another example, an siNA molecule comprises two blunt ends, for example wherein the 3'-end of the antisense strand and the 5'-end of the sense strand as well as the 5'-end of the antisense strand and 3'-end of the sense strand do not have any overhanging nucleotides. A blunt ended siNA molecule can comprise, for example, from about 18 to about 30 nucleotides (e.g., about 18, 19, 20, 21, 22, 23, 24, 25, 26, 27, 28, 29, or 30 nucleotides). Other nucleotides present in a blunt ended siNA molecule can comprise mismatches, bulges, loops, or wobble base pairs, for example, to modulate the activity of the siNA molecule to mediate RNA interference.

By "blunt ends" is meant symmetric termini or termini of a double-stranded siNA molecule having no overhanging nucleotides. The two strands of a double-stranded siNA molecule align with each other without over-hanging nucleotides at the termini. For example, a blunt ended siNA construct comprises terminal nucleotides that are complementary between the sense and antisense regions of the siNA molecule.

In one embodiment, the invention features a double-stranded short interfering nucleic acid (siNA) molecule that down-regulates expression of a interleukin and/or interleukin receptor gene, wherein the siNA molecule is assembled from two separate oligonucleotide fragments wherein one fragment comprises the sense region and the second fragment comprises the antisense region of the siNA molecule. The sense region can be connected to the antisense region via a linker molecule, such as a polynucleotide linker or a non-nucleotide linker.

In one embodiment, the invention features double-stranded short interfering nucleic acid (siNA) molecule that down-regulates expression of a interleukin and/or interleukin receptor gene, wherein the siNA molecule comprises about 19 to about 21 base pairs, and wherein each strand of the siNA molecule comprises one or more chemical modifications. In another embodiment, one of the strands of the double-stranded siNA molecule comprises a nucleotide sequence that is complementary to a nucleotide sequence of a interleukin and/or interleukin receptor gene or a portion thereof, and the second strand of the double-stranded siNA molecule comprises a nucleotide sequence substantially similar to the nucleotide sequence or a portion thereof of the interleukin and/or interleukin receptor gene. In another embodiment, one of the strands of the double-stranded siNA molecule comprises a nucleotide sequence that is complementary to a nucleotide sequence of a interleukin and/or interleukin receptor gene or portion thereof, and the second strand of the double-stranded siNA molecule comprises a nucleotide sequence substantially similar to the nucleotide sequence or portion thereof of the interleukin and/or interleukin receptor gene. In another embodiment, each strand of the siNA molecule comprises about 19 to about 23 nucleotides, and each strand comprises at least about 19 nucleotides that are complementary to the nucleotides of the other strand. The interleukin and/or interleukin receptor gene can comprise, for example, sequences referred to in Table I.

In one embodiment, an siNA molecule of the invention comprises no ribonucleotides. In another embodiment, an siNA molecule of the invention comprises ribonucleotides.

In one embodiment, an siNA molecule of the invention comprises an antisense region comprising a nucleotide sequence that is complementary to a nucleotide sequence of a interleukin and/or interleukin receptor gene or a portion thereof, and the siNA further comprises a sense region comprising a nucleotide sequence substantially similar to the nucleotide sequence of the interleukin and/or interleukin receptor gene or a portion thereof. In another embodiment, the antisense region and the sense region each comprise about 19 to about 23 nucleotides and the antisense region comprises at least about 19 nucleotides that are complementary to nucleotides of the sense region. The interleukin and/or interleukin receptor gene can comprise, for example, sequences referred to in Table I.

In one embodiment, an siNA molecule of the invention comprises a sense region and an antisense region, wherein the antisense region comprises a nucleotide sequence that is complementary to a nucleotide sequence of RNA encoded by a interleukin and/or interleukin receptor gene, or a portion thereof, and the sense region comprises a nucleotide sequence that is complementary to the antisense region. In one embodiment, the siNA molecule is assembled from two separate oligonucleotide fragments, wherein one fragment comprises the sense region and the second fragment comprises the antisense region of the siNA molecule. In another embodiment, the sense region is connected to the antisense region via a linker molecule. In another embodiment, the sense region is connected to the antisense region via a linker molecule, such as a nucleotide or non-nucleotide linker. The interleukin and/or interleukin receptor gene can comprise, for example, sequences referred in to Table I.

In one embodiment, the invention features a double-stranded short interfering nucleic acid (siNA) molecule that down-regulates expression of a interleukin and/or interleukin receptor gene comprising a sense region and an antisense region, wherein the antisense region comprises a nucleotide sequence that is complementary to a nucleotide sequence of RNA encoded by the interleukin and/or interleukin receptor gene or a portion thereof and the sense region comprises a nucleotide sequence that is complementary to the antisense region, and wherein the siNA molecule has one or more modified pyrimidine and/or purine nucleotides. In one embodiment, the pyrimidine nucleotides in the sense region are 2'-O-methylpyrimidine nucleotides or 2'-deoxy-2'-fluoro pyrimidine nucleotides and the purine nucleotides present in the sense region are 2'-deoxy purine nucleotides. In another embodiment, the pyrimidine nucleotides in the sense region are 2'-deoxy-2'-fluoro pyrimidine nucleotides and the purine nucleotides present in the sense region are 2'-O-methyl purine nucleotides. In another embodiment, the pyrimidine nucleotides in the sense region are 2'-deoxy-2'-fluoro pyrimidine nucleotides and the purine nucleotides present in the sense region are 2'-deoxy purine nucleotides. In one embodiment, the pyrimidine nucleotides in the antisense region are 2'-deoxy-2'-fluoro pyrimidine nucleotides and the purine nucleotides present in the antisense region are 2'-O-methyl or 2'-deoxy purine nucleotides. In another embodiment of any of the above-described siNA molecules, any nucleotides present in a non-complementary region of the sense strand (e.g. overhang region) are 2'-deoxy nucleotides.

In one embodiment, the invention features a double-stranded short interfering nucleic acid (siNA) molecule that down-regulates expression of a interleukin and/or interleukin receptor gene, wherein the siNA molecule is assembled from two separate oligonucleotide fragments wherein one fragment comprises the sense region and the second fragment comprises the antisense region of the siNA molecule, and wherein the fragment comprising the sense region includes a terminal cap moiety at the 5'-end, the 3'-end, or both of the 5' and 3' ends of the fragment. In one embodiment, the terminal cap moiety is an inverted deoxy abasic moiety or glyceryl moiety. In one embodiment, each of the two fragments of the siNA molecule comprise about 21 nucleotides.

In one embodiment, the invention features an siNA molecule comprising at least one modified nucleotide, wherein the modified nucleotide is a 2'-deoxy-2'-fluoro nucleotide. The siNA can be, for example, of length between about 12 and about 36 nucleotides. In one embodiment, all pyrimidine nucleotides present in the siNA are 2'-deoxy-2'-fluoro pyrimidine nucleotides. In one embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-deoxy-2'-fluoro cytidine and at least one 2'-deoxy-2'-fluoro uridine nucleotides. In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a method of increasing the stability of an siNA molecule against cleavage by ribonucleases comprising introducing at least one modified nucleotide into the siNA molecule, wherein the modified nucleotide is a 2'-deoxy-2'-fluoro nucleotide. In one embodiment, all pyrimidine nucleotides present in the siNA are 2'-deoxy-2'-fluoro pyrimidine nucleotides. In one embodiment, the modified nucleotides in the siNA include at least one 2'-deoxy-2'-fluoro cytidine or 2'-deoxy-2'-fluoro uridine nucleotide. In another embodiment, the modified nucleotides in the siNA include at least one 2'-deoxy-2'-fluoro cytidine and at least one 2'-deoxy-2'-fluoro uridine nucleotides. In one embodiment, all uridine nucleotides present in the siNA are 2'-deoxy-2'-fluoro uridine nucleotides. In one embodiment, all cytidine nucleotides present in the siNA are 2'-deoxy-2'-fluoro cytidine nucleotides. In one embodiment, all adenosine nucleotides present in the siNA are 2'-deoxy-2'-fluoro adenosine nucleotides. In one embodiment, all guanosine nucleotides present in the siNA are 2'-deoxy-2'-fluoro guanosine nucleotides. The siNA can further comprise at least one modified internucleotidic linkage, such as phosphorothioate linkage. In one embodiment, the 2'-deoxy-2'-fluoronucleotides are present at specifically selected locations in the siNA that are sensitive to cleavage by ribonucleases, such as locations having pyrimidine nucleotides.

In one embodiment, the invention features a double-stranded short interfering nucleic acid (siNA) molecule that down-regulates expression of a interleukin and/or interleukin receptor gene comprising a sense region and an antisense region, wherein the antisense region comprises a nucleotide sequence that is complementary to a nucleotide sequence of RNA encoded by the interleukin and/or interleukin receptor gene or a portion thereof and the sense region comprises a nucleotide sequence that is complementary to the antisense region, and wherein the purine nucleotides present in the antisense region comprise 2'-deoxy-purine nucleotides. In an alternative embodiment, the purine nucleotides present in the antisense region comprise 2'-O-methyl purine nucleotides. In either of the above embodiments, the antisense region can comprise a phosphorothioate internucleotide linkage at the 3' end of the antisense region. Alternatively, in either of the above embodiments, the antisense region can comprise a glyceryl modification at the 3' end of the antisense region. In another embodiment of any of the above-described siNA molecules, any nucleotides present in a non-complementary region of the antisense strand (e.g. overhang region) are 2'-deoxy nucleotides.

In one embodiment, the antisense region of an siNA molecule of the invention comprises sequence complementary to a portion of a interleukin and/or interleukin receptor transcript having sequence unique to a particular interleukin and/or interleukin receptor disease related allele, such as sequence comprising a single nucleotide polymorphism (SNP) associated with the disease specific allele. As such, the antisense region of an siNA molecule of the invention can comprise sequence complementary to sequences that are unique to a particular allele to provide specificity in mediating selective RNAi against the disease, condition, or trait related allele.

In one embodiment, the invention features a double-stranded short interfering nucleic acid (siNA) molecule that down-regulates expression of a interleukin and/or interleukin receptor gene, wherein the siNA molecule is assembled from two separate oligonucleotide fragments wherein one fragment comprises the sense region and the second fragment comprises the antisense region of the siNA molecule. In another embodiment about 19 nucleotides of each fragment of the siNA molecule are base-paired to the complementary nucleotides of the other fragment of the siNA molecule and wherein at least two 3' terminal nucleotides of each fragment of the siNA molecule are not base-paired to the nucleotides of the other fragment of the siNA molecule. In one embodiment, each of the two 3' terminal nucleotides of each fragment of the siNA molecule is a 2'-deoxy-pyrimidine nucleotide, such as a 2'-deoxy-thymidine. In another embodiment, all 21 nucleotides of each fragment of the siNA molecule are base-paired to the complementary nucleotides of the other fragment of the siNA molecule. In another embodiment, about 19 nucleotides of the antisense region are base-paired to the nucleotide sequence or a portion thereof of the RNA encoded by the interleukin and/or interleukin receptor gene. In another embodiment, about 21 nucleotides of the antisense region are base-paired to the nucleotide sequence or a portion thereof of the RNA encoded by the interleukin and/or interleukin receptor gene. In any of the above embodiments, the 5'-end of the fragment comprising said antisense region can optionally include a phosphate group.

In one embodiment, the invention features a double-stranded short interfering nucleic acid (siNA) molecule that inhibits the expression of a interleukin and/or interleukin receptor RNA sequence (e.g., wherein said target RNA sequence is encoded by a interleukin and/or interleukin receptor gene involved in the interleukin and/or interleukin receptor pathway), wherein the siNA molecule does not contain any ribonucleotides and wherein each strand of the double-stranded siNA molecule is about 21 nucleotides long. Examples of non-ribonucleotide containing siNA constructs are combinations of stabilization chemistries shown in Table IV in any combination of Sense/Antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, or Stab 18/20.

In one embodiment, the invention features a chemically synthesized double-stranded RNA molecule that directs cleavage of a interleukin and/or interleukin receptor RNA via RNA interference, wherein each strand of said RNA molecule is about 21 to about 23 nucleotides in length; one strand of the RNA molecule comprises nucleotide sequence having sufficient complementarity to the interleukin and/or interleukin receptor RNA for the RNA molecule to direct cleavage of the interleukin and/or interleukin receptor RNA via RNA interference; and wherein at least one strand of the RNA molecule comprises one or more chemically modified nucleotides described herein, such as deoxynucleotides, 2'-O-methyl nucleotides, 2'-deoxy-2'-fluoro nucleotides, 2'-O-methoxyethyl nucleotides etc.

In one embodiment, the invention features a medicament comprising an siNA molecule of the invention.

In one embodiment, the invention features an active ingredient comprising an siNA molecule of the invention.

In one embodiment, the invention features the use of a double-stranded short interfering nucleic acid (siNA) molecule to down-regulate expression of a interleukin and/or interleukin receptor gene, wherein the siNA molecule comprises one or more chemical modifications and each strand of the double-stranded siNA is about 18 to about 28 or more (e.g., about 18, 19, 20, 21, 22, 23, 24, 25, 26, 27, or 28 or more) nucleotides long.

In one embodiment, the invention features the use of a double-stranded short interfering nucleic acid (siNA) molecule that inhibits expression of a interleukin and/or interleukin receptor gene, wherein one of the strands of the double-stranded siNA molecule is an antisense strand which comprises nucleotide sequence that is complementary to nucleotide sequence of interleukin and/or interleukin receptor RNA or a portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification.

In one embodiment, the invention features a double-stranded short interfering nucleic acid (siNA) molecule that inhibits expression of a interleukin and/or interleukin receptor gene, wherein one of the strands of the double-stranded siNA molecule is an antisense strand which comprises nucleotide sequence that is complementary to nucleotide sequence of interleukin and/or interleukin receptor RNA or a portion thereof, wherein the other strand is a sense strand which comprises nucleotide sequence that is complementary to a nucleotide sequence of the antisense strand and wherein a majority of the pyrimidine nucleotides present in the double-stranded siNA molecule comprises a sugar modification.

In one embodiment, the invention features a double-stranded short interfering nucleic acid (siNA) molecule that inhibits expression of a interleukin and/or interleukin receptor gene, wherein one of the strands of the double-stranded siNA molecule is an antisense strand which comprises nucleotide sequence that is complementary to nucleotide sequence of interleukin and/or interleukin receptor RNA that encodes a protein or portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification. In one embodiment, each strand of the siNA molecule comprises about 18 to about 29 or more (e.g., about 18, 19, 20, 21, 22, 23, 24, 25, 26, 27, 28, or 29 or more) nucleotides, wherein each strand comprises at least about 18 nucleotides that are complementary to the nucleotides of the other strand. In one embodiment, the siNA molecule is assembled from two oligonucleotide fragments, wherein one fragment comprises the nucleotide sequence of the antisense strand of the siNA molecule and a second fragment comprises nucleotide sequence of the sense region of the siNA molecule. In one embodiment, the sense strand is connected to the antisense strand via a linker molecule, such as a polynucleotide linker or a non-nucleotide linker. In a further embodiment, the pyrimidine nucleotides present in the sense strand are 2'-deoxy-2'fluoro pyrimidine nucleotides and the purine nucleotides present in the sense region are 2'-deoxy purine nucleotides. In another embodiment, the pyrimidine nucleotides present in the sense strand are 2'-deoxy-2'-fluoro pyrimidine nucleotides and the purine nucleotides present in the sense region are 2'-O-methyl purine nucleotides. In still another embodiment, the pyrimidine nucleotides present in the antisense strand are 2'-deoxy-2'-fluoro pyrimidine nucleotides and any purine nucleotides present in the antisense strand are 2'-deoxy purine nucleotides. In another embodiment, the antisense strand comprises one or more 2'-deoxy-2'-fluoro pyrimidine nucleotides and one or more 2'-O-methyl purine nucleotides. In another embodiment, the pyrimidine nucleotides present in the antisense strand are 2'-deoxy-2'-fluoro pyrimidine nucleotides and any purine nucleotides present in the antisense strand are 2'-O-methyl purine nucleotides. In a further embodiment the sense strand comprises a 3'-end and a 5'-end, wherein a terminal cap moiety (e.g., an inverted deoxy abasic moiety or inverted deoxy nucleotide moiety such as inverted thymidine) is present at the 5'-end, the 3'-end, or both of the 5' and 3' ends of the sense strand. In another embodiment, the antisense strand comprises a phosphorothioate internucleotide linkage at the 3' end of the antisense strand. In another embodiment, the antisense strand comprises a glyceryl modification at the 3' end. In another embodiment, the 5'-end of the antisense strand optionally includes a phosphate group.

In any of the above-described embodiments of a double-stranded short interfering nucleic acid (siNA) molecule that inhibits expression of a interleukin and/or interleukin receptor gene, wherein a majority of the pyrimidine nucleotides present in the double-stranded siNA molecule comprises a sugar modification, each of the two strands of the siNA molecule can comprise about 21 nucleotides. In one embodiment, about 21 nucleotides of each strand of the siNA molecule are base-paired to the complementary nucleotides of the other strand of the siNA molecule. In another embodiment, about 19 nucleotides of each strand of the siNA molecule are base-paired to the complementary nucleotides of the other strand of the siNA molecule, wherein at least two 3' terminal nucleotides of each strand of the siNA molecule are not base-paired to the nucleotides of the other strand of the siNA molecule. In another embodiment, each of the two 3' terminal nucleotides of each fragment of the siNA molecule is a 2'-deoxy-pyrimidine, such as 2'-deoxy-thymidine. In one embodiment, each strand of the siNA molecule is base-paired to the complementary nucleotides of the other strand of the siNA molecule. In one embodiment, about 19 nucleotides of the antisense strand are base-paired to the nucleotide sequence of the interleukin and/or interleukin receptor RNA or a portion thereof. In one embodiment, about 21 nucleotides of the antisense strand are base-paired to the nucleotide sequence of the interleukin and/or interleukin receptor RNA or a portion thereof.

In one embodiment, the invention features a double-stranded short interfering nucleic acid (siNA) molecule that inhibits expression of a interleukin and/or interleukin receptor gene, wherein one of the strands of the double-stranded siNA molecule is an antisense strand which comprises nucleotide sequence that is complementary to nucleotide sequence of interleukin and/or interleukin receptor RNA or a portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification, and wherein the 5'-end of the antisense strand optionally includes a phosphate group.

In one embodiment, the invention features a double-stranded short interfering nucleic acid (siNA) molecule that inhibits expression of a interleukin and/or interleukin receptor gene, wherein one of the strands of the double-stranded siNA molecule is an antisense strand which comprises nucleotide sequence that is complementary to nucleotide sequence of interleukin and/or interleukin receptor RNA or a portion thereof, the other strand is a sense strand which comprises nucleotide sequence that is complementary to a nucleotide sequence of the antisense strand and wherein a majority of the pyrimidine nucleotides present in the double-stranded siNA molecule comprises a sugar modification, and wherein the nucleotide sequence or a portion thereof of the antisense strand is complementary to a nucleotide sequence of the untranslated region or a portion thereof of the interleukin and/or interleukin receptor RNA.

In one embodiment, the invention features a double-stranded short interfering nucleic acid (siNA) molecule that inhibits expression of a interleukin and/or interleukin receptor gene, wherein one of the strands of the double-stranded siNA molecule is an antisense strand which comprises nucleotide sequence that is complementary to nucleotide sequence of interleukin and/or interleukin receptor RNA or a portion thereof, wherein the other strand is a sense strand which comprises nucleotide sequence that is complementary to a nucleotide sequence of the antisense strand, wherein a majority of the pyrimidine nucleotides present in the double-stranded siNA molecule comprises a sugar modification, and wherein the nucleotide sequence of the antisense strand is complementary to a nucleotide sequence of the interleukin and/or interleukin receptor RNA or a portion thereof that is present in the interleukin and/or interleukin receptor RNA.

In one embodiment, the invention features a composition comprising an siNA molecule of the invention in a pharmaceutically acceptable carrier or diluent.

In a non-limiting example, the introduction of chemically-modified nucleotides into nucleic acid molecules provides a powerful tool in overcoming potential limitations of in vivo stability and bioavailability inherent to native RNA molecules that are delivered exogenously. For example, the use of chemically-modified nucleic acid molecules can enable a lower dose of a particular nucleic acid molecule for a given therapeutic effect since chemically-modified nucleic acid molecules tend to have a longer half-life in serum. Furthermore, certain chemical modifications can improve the bioavailability of nucleic acid molecules by targeting particular cells or tissues and/or improving cellular uptake of the nucleic acid molecule. Therefore, even if the activity of a chemically-modified nucleic acid molecule is reduced as compared to a native nucleic acid molecule, for example, when compared to an all-RNA nucleic acid molecule, the overall activity of the modified nucleic acid molecule can be greater than that of the native molecule due to improved stability and/or delivery of the molecule. Unlike native unmodified siNA, chemically-modified siNA can also minimize the possibility of activating interferon activity in humans.

In any of the embodiments of siNA molecules described herein, the antisense region of an siNA molecule of the invention can comprise a phosphorothioate internucleotide linkage at the 3'-end of said antisense region. In any of the embodiments of siNA molecules described herein, the antisense region can comprise about one to about five phosphorothioate internucleotide linkages at the 5'-end of said antisense region. In any of the embodiments of siNA molecules described herein, the 3'-terminal nucleotide overhangs of an siNA molecule of the invention can comprise ribonucleotides or deoxyribonucleotides that are chemically-modified at a nucleic acid sugar, base, or backbone. In any of the embodiments of siNA molecules described herein, the 3'-terminal nucleotide overhangs can comprise one or more universal base ribonucleotides. In any of the embodiments of siNA molecules described herein, the 3'-terminal nucleotide overhangs can comprise one or more acyclic nucleotides.

One embodiment of the invention provides an expression vector comprising a nucleic acid sequence encoding at least one siNA molecule of the invention in a manner that allows expression of the nucleic acid molecule. Another embodiment of the invention provides a mammalian cell comprising such an expression vector. The mammalian cell can be a human cell. The siNA molecule of the expression vector can comprise a sense region and an antisense region. The antisense region can comprise sequence complementary to a RNA or DNA sequence encoding interleukin and/or interleukin receptor and the sense region can comprise sequence complementary to the antisense region. The siNA molecule can comprise two distinct strands having complementary sense and antisense regions. The siNA molecule can comprise a single strand having complementary sense and antisense regions.

In one embodiment, the invention features a chemically-modified short interfering nucleic acid (siNA) molecule capable of mediating RNA interference (RNAi) against interleukin and/or interleukin receptor inside a cell or reconstituted in vitro system, wherein the chemical modification comprises one or more (e.g., about 1, 2, 3, 4, 5, 6, 7, 8, 9, 10, or more) nucleotides comprising a backbone modified internucleotide linkage having Formula I:

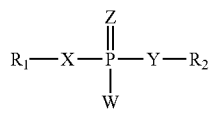

wherein each R1 and R2 is independently any nucleotide, non-nucleotide, or polynucleotide which can be naturally-occurring or chemically-modified, each X and Y is independently O, S, N, alkyl, or substituted alkyl, each Z and W is independently O, S, N, alkyl, substituted alkyl, O-alkyl, S-alkyl, alkaryl, aralkyl, or acetyl and wherein W, X, Y, and Z are optionally not all O. In another embodiment, a backbone modification of the invention comprises a phosphonoacetate and/or thiophosphonoacetate internucleotide linkage (see for example Sheehan et al., 2003, *Nucleic Acids Research*, 31, 4109-4118).

The chemically-modified internucleotide linkages having Formula I, for example, wherein any Z, W, X, and/or Y independently comprises a sulphur atom, can be present in one or both oligonucleotide strands of the siNA duplex, for example, in the sense strand, the antisense strand, or both strands. The siNA molecules of the invention can comprise one or more (e.g., about 1, 2, 3, 4, 5, 6, 7, 8, 9, 10, or more) chemically-modified internucleotide linkages having Formula I at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified internucleotide linkages having Formula I at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine nucleotides with chemically-modified internucleotide linkages having Formula I in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine nucleotides with chemically-modified internucleotide linkages having Formula I in the sense strand, the antisense strand, or both strands. In another embodiment, an siNA molecule of the invention having internucleotide linkage(s) of Formula I also comprises a chemically-modified nucleotide or non-nucleotide having any of Formulae I-VII.

In one embodiment, the invention features a chemically-modified short interfering nucleic acid (siNA) molecule capable of mediating RNA interference (RNAi) against interleukin and/or interleukin receptor inside a cell or reconstituted in vitro system, wherein the chemical modification comprises one or more (e.g., about 1, 2, 3, 4, 5, 6, 7, 8, 9, 10, or more) nucleotides or non-nucleotides having Formula II:

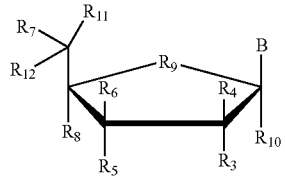

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA.

The chemically-modified nucleotide or non-nucleotide of Formula II can be present in one or both oligonucleotide strands of the siNA duplex, for example in the sense strand, the antisense strand, or both strands. The siNA molecules of the invention can comprise one or more chemically-modified nucleotide or non-nucleotide of Formula II at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotides or non-nucleotides of Formula II at the 5'-end of the sense strand, the antisense strand, or both strands. In anther non-limiting example, an exemplary siNA molecule of the invention can comprise about 1 to about 5 or more (e.g., about 1, 2, 3, 4, 5, or more) chemically-modified nucleotides or non-nucleotides of Formula II at the 3'-end of the sense strand, the antisense strand, or both strands.

In one embodiment, the invention features a chemically-modified short interfering nucleic acid (siNA) molecule capable of mediating RNA interference (RNAi) against interleukin and/or interleukin receptor inside a cell or reconstituted in vitro system, wherein the chemical modification comprises one or more (e.g., about 1, 2, 3, 4, 5, 6, 7, 8, 9, 10, or more) nucleotides or non-nucleotides having Formula III:

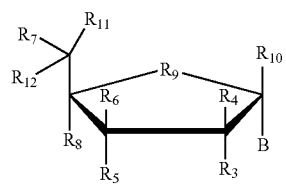

wherein each R3, R4, R5, R6, R7, R8, R10, R11 and R12 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-S-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2, and B is a nucleosidic base such as adenine, guanine, uracil, cytosine, thymine, 2-aminoadenosine, 5-methylcytosine, 2,6-diaminopurine, or any other non-naturally occurring base that can be employed to be complementary or non-complementary to target RNA or a non-nucleosidic base such as phenyl, naphthyl, 3-nitropyrrole, 5-nitroindole, nebularine, pyridone, pyridinone, or any other non-naturally occurring universal base that can be complementary or non-complementary to target RNA.

The chemically-modified nucleotide or non-nucleotide of Formula III can be present in one or both oligonucleotide strands of the siNA duplex, for example, in the sense strand, the antisense strand, or both strands. The siNA molecules of the invention can comprise one or more chemically-modified nucleotide or non-nucleotide of Formula III at the 3'-end, the 5'-end, or both of the 3' and 5'-ends of the sense strand, the antisense strand, or both strands. For example, an exemplary siNA molecule of the invention can comprise about 1 to about 5 or more (e.g., about 1, 2, 3, 4, 5, or more) chemically-modified nucleotide(s) or non-nucleotide(s) of Formula III at the 5'-end of the sense strand, the antisense strand, or both strands. In anther non-limiting example, an exemplary siNA molecule of the invention can comprise about 1 to about 5 or more (e.g., about 1, 2, 3, 4, 5, or more) chemically-modified nucleotide or non-nucleotide of Formula III at the 3'-end of the sense strand, the antisense strand, or both strands.

In another embodiment, an siNA molecule of the invention comprises a nucleotide having Formula II or III, wherein the nucleotide having Formula II or III is in an inverted configuration. For example, the nucleotide having Formula II or III is connected to the siNA construct in a 3'-3',3'-2',2'-3', or 5'-5' configuration, such as at the 3'-end, the 5'-end, or both of the 3' and 5'-ends of one or both siNA strands.

In one embodiment, the invention features a chemically-modified short interfering nucleic acid (siNA) molecule capable of mediating RNA interference (RNAi) against interleukin and/or interleukin receptor inside a cell or reconstituted in vitro system, wherein the chemical modification comprises a 5'-terminal phosphate group having Formula IV:

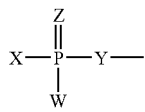

wherein each X and Y is independently O, S, N, alkyl, substituted alkyl, or alkylhalo; wherein each Z and W is independently O, S, N, alkyl, substituted alkyl, O-alkyl, S-alkyl, alkaryl, aralkyl, alkylhalo, or acetyl; and wherein W, X, Y and Z are not all O.

In one embodiment, the invention features an siNA molecule having a 5'-terminal phosphate group having Formula IV on the target-complementary strand, for example, a strand complementary to a target RNA, wherein the siNA molecule comprises an all RNA siNA molecule. In another embodiment, the invention features an siNA molecule having a 5'-terminal phosphate group having Formula IV on the target-complementary strand wherein the siNA molecule also comprises about 1 to about 3 (e.g., about 1, 2, or 3) nucleotide 3'-terminal nucleotide overhangs having about 1 to about 4 (e.g., about 1, 2, 3, or 4) deoxyribonucleotides on the 3'-end of one or both strands. In another embodiment, a 5'-terminal phosphate group having Formula IV is present on the target-complementary strand of an siNA molecule of the invention, for example an siNA molecule having chemical modifications having any of Formulae I-VII.

In one embodiment, the invention features a chemically-modified short interfering nucleic acid (siNA) molecule capable of mediating RNA interference (RNAi) against interleukin and/or interleukin receptor inside a cell or reconstituted in vitro system, wherein the chemical modification comprises one or more phosphorothioate internucleotide linkages. For example, in a non-limiting example, the invention features a chemically-modified short interfering nucleic acid (siNA) having about 1, 2, 3, 4, 5, 6, 7, 8 or more phosphorothioate internucleotide linkages in one siNA strand. In yet another embodiment, the invention features a chemically-modified short interfering nucleic acid (siNA) individually having about 1, 2, 3, 4, 5, 6, 7, 8 or more phosphorothioate internucleotide linkages in both siNA strands. The phosphorothioate internucleotide linkages can be present in one or both oligonucleotide strands of the siNA duplex, for example in the sense strand, the antisense strand, or both strands. The siNA molecules of the invention can comprise one or more phosphorothioate internucleotide linkages at the 3'-end, the 5'-end, or both of the 3'- and 5'-ends of the sense strand, the antisense strand, or both strands. For example, an exemplary siNA molecule of the invention can comprise about 1 to about 5 or more (e.g., about 1, 2, 3, 4, 5, or more) consecutive phosphorothioate internucleotide linkages at the 5'-end of the sense strand, the antisense strand, or both strands. In another non-limiting example, an exemplary siNA molecule of the invention can comprise one or more (e.g., about 1, 2, 3, 4, 5, 6, 7, 8, 9, 10, or more) pyrimidine phosphorothioate internucleotide linkages in the sense strand, the antisense strand, or both strands. In yet another non-limiting example, an exemplary siNA molecule of the invention can comprise one or more (e.g., about 1, 2, 3, 4, 5, 6, 7, 8, 9, 10, or more) purine phosphorothioate internucleotide linkages in the sense strand, the antisense strand, or both strands.

In one embodiment, the invention features an siNA molecule, wherein the sense strand comprises one or more, for example, about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or about one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl and/or 2'-deoxy-2'-fluoro nucleotides, with or without one or more, for example about 1, 2, 3, 4, 5, 6, 7, 8, 9, 10, or more, phosphorothioate internucleotide linkages and/or a terminal cap molecule at the 3'-end, the 5'-end, or both of the 3'- and 5'-ends, being present in the same or different strand.

In another embodiment, the invention features an siNA molecule, wherein the sense strand comprises about 1 to about 5, specifically about 1, 2, 3, 4, or 5 phosphorothioate internucleotide linkages, and/or one or more (e.g., about 1, 2, 3, 4, 5, or more) 2'-deoxy, 2'-O-methyl, 2'-deoxy-2'-fluoro, and/or one or more (e.g., about 1, 2, 3, 4, 5, or more) universal base modified nucleotides, and optionally a terminal cap molecule at the 3-end, the 5'-end, or both of the 3'- and 5'-ends of the sense strand; and wherein the antisense strand comprises about 1 to about 5 or more, specifically about 1, 2, 3, 4, 5, or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10, or more, pyrimidine nucleotides of the sense and/or antisense siNA strand are chemically-modified with 2'-deoxy, 2'-O-methyl and/or 2'-deoxy-2'-fluoro nucleotides, with or without about 1 to about 5 or more, for example about 1, 2, 3, 4, 5, or more phosphorothioate internucleotide linkages and/or a terminal cap molecule at the 3'-end, the 5'-end, or both of the 3'- and 5'-ends, being present in the same or different strand.

In one embodiment, the invention features an siNA molecule, wherein the antisense strand comprises one or more, for example, about 1, 2, 3, 4, 5, 6, 7, 8, 9, 10, or more phosphorothioate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 10 or more, specifically about 1, 2, 3, 4, 5, 6, 7, 8, 9, 10 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl and/or 2'-deoxy-2'-fluoro nucleotides, with or without one or more, for example, about 1, 2, 3, 4, 5, 6, 7, 8, 9, 10 or more phosphorothioate internucleotide linkages and/or a terminal cap molecule at the 3'-end, the 5'-end, or both of the 3' and 5'-ends, being present in the same or different strand.

In another embodiment, the invention features an siNA molecule, wherein the antisense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and wherein the antisense strand comprises about 1 to about 5 or more, specifically about 1, 2, 3, 4, 5 or more phosphorothioate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In another embodiment, one or more, for example about 1, 2, 3, 4, 5, 6, 7, 8, 9, 10 or more pyrimidine nucleotides of the sense and/or antisense siNA strand are chemically-modified with 2'-deoxy, 2'-O-methyl and/or 2'-deoxy-2'-fluoro nucleotides, with or without about 1 to about 5, for example about 1, 2, 3, 4, 5 or more phosphorothioate internucleotide linkages and/or a terminal cap molecule at the 3'-end, the 5'-end, or both of the 3'- and 5'-ends, being present in the same or different strand.

In one embodiment, the invention features a chemically-modified short interfering nucleic acid (siNA) molecule having about 1 to about 5, specifically about 1, 2, 3, 4, 5 or more phosphorothioate internucleotide linkages in each strand of the siNA molecule.

In another embodiment, the invention features an siNA molecule comprising 2'-5' internucleotide linkages. The 2'-5' internucleotide linkage(s) can be at the 3'-end, the 5'-end, or both of the 3'- and 5'-ends of one or both siNA sequence strands. In addition, the 2'-5' internucleotide linkage(s) can be present at various other positions within one or both siNA sequence strands, for example, about 1, 2, 3, 4, 5, 6, 7, 8, 9, 10, or more including every internucleotide linkage of a pyrimidine nucleotide in one or both strands of the siNA molecule can comprise a 2'-5' internucleotide linkage, or about 1, 2, 3, 4, 5, 6, 7, 8, 9, 10, or more including every internucleotide linkage of a purine nucleotide in one or both strands of the siNA molecule can comprise a 2'-5' internucleotide linkage.

In another embodiment, a chemically-modified siNA molecule of the invention comprises a duplex having two strands, one or both of which can be chemically-modified, wherein each strand is about 18 to about 27 (e.g., about 18, 19, 20, 21, 22, 23, 24, 25, 26, or 27) nucleotides in length, wherein the duplex has about 18 to about 23 (e.g., about 18, 19, 20, 21, 22, or 23) base pairs, and wherein the chemical modification comprises a structure having any of Formulae I-VII. For example, an exemplary chemically-modified siNA molecule of the invention comprises a duplex having two strands, one or both of which can be chemically-modified with a chemical modification having any of Formulae I-VII or any combination thereof, wherein each strand consists of about 21 nucleotides, each having a 2-nucleotide 3'-terminal nucleotide overhang, and wherein the duplex has about 19 base pairs. In another embodiment, an siNA molecule of the invention comprises a single-stranded hairpin structure, wherein the siNA is about 36 to about 70 (e.g., about 36, 40, 45, 50, 55, 60, 65, or 70) nucleotides in length having about 18 to about 23 (e.g., about 18, 19, 20, 21, 22, or 23) base pairs, and wherein the siNA can include a chemical modification comprising a structure having any of Formulae I-VII or any combination thereof. For example, an exemplary chemically-modified siNA molecule of the invention comprises a linear oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the linear oligonucleotide forms a hairpin structure having about 19 base pairs and a 2-nucleotide 3'-terminal nucleotide overhang. In another embodiment, a linear hairpin siNA molecule of the invention contains a stem loop motif, wherein the loop portion of the siNA molecule is biodegradable. For example, a linear hairpin siNA molecule of the invention is designed such that degradation of the loop portion of the siNA molecule in vivo can generate a double-stranded siNA molecule with 3'-terminal overhangs, such as 3'-terminal nucleotide overhangs comprising about 2 nucleotides.

In another embodiment, an siNA molecule of the invention comprises a hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 25 (e.g., about 3, 4, 5, 6, 7, 8, 9, 10, 11, 12, 13, 14, 15, 16, 17, 18, 19, 20, 21, 22, 23, 24, or 25) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms a hairpin structure having about 3 to about 23 (e.g., about 3, 4, 5, 6, 7, 8, 9, 10, 11, 12, 13, 14, 15, 16, 17, 18, 19, 20, 21, 22, or 23) base pairs and a 5'-terminal phosphate group that can be chemically modified as described herein (for example a 5'-terminal phosphate group having Formula IV). In another embodiment, a linear hairpin siNA molecule of the invention contains a stem loop motif, wherein the loop portion of the siNA molecule is biodegradable. In one embodiment, a linear hairpin siNA molecule of the invention comprises a loop portion comprising a non-nucleotide linker.

In another embodiment, an siNA molecule of the invention comprises an asymmetric hairpin structure, wherein the siNA is about 25 to about 50 (e.g., about 25, 26, 27, 28, 29, 30, 31, 32, 33, 34, 35, 36, 37, 38, 39, 40, 41, 42, 43, 44, 45, 46, 47, 48, 49, or 50) nucleotides in length having about 3 to about 20 (e.g., about 3, 4, 5, 6, 7, 8, 9, 10, 11, 12, 13, 14, 15, 16, 17, 18, 19, or 20) base pairs, and wherein the siNA can include one or more chemical modifications comprising a structure having any of Formulae I-VII or any combination thereof. For example, an exemplary chemically-modified siNA molecule of the invention comprises a linear oligonucleotide having about 25 to about 35 (e.g., about 25, 26, 27, 28, 29, 30, 31, 32, 33, 34, or 35) nucleotides that is chemically-modified with one or more chemical modifications having any of Formulae I-VII or any combination thereof, wherein the linear oligonucleotide forms an asymmetric hairpin structure having about 3 to about 18 (e.g., about 3, 4, 5, 6, 7, 8, 9, 10, 11, 12, 13, 14, 15, 16, 17, or 18) base pairs and a 5'-terminal phosphate group that can be chemically modified as described herein (for example a 5'-terminal phosphate group having Formula IV). In one embodiment, an asymmetric hairpin siNA molecule of the invention contains a stem loop motif, wherein the loop portion of the siNA molecule is biodegradable. In another embodiment, an asymmetric hairpin siNA molecule of the invention comprises a loop portion comprising a non-nucleotide linker.

In another embodiment, an siNA molecule of the invention comprises an asymmetric double-stranded structure having separate polynucleotide strands comprising sense and antisense regions, wherein the antisense region is about 16 to about 25 (e.g., about 16, 17, 18, 19, 20, 21, 22, 23, 24, or 25) nucleotides in length, wherein the sense region is about 3 to about 18 (e.g., about 3, 4, 5, 6, 7, 8, 9, 10, 11, 12, 13, 14, 15, 16, 17, or 18) nucleotides in length, wherein the sense region and the antisense region have at least 3 complementary nucleotides, and wherein the siNA can include one or more chemical modifications comprising a structure having any of Formulae I-VII or any combination thereof. For example, an exemplary chemically-modified siNA molecule of the invention comprises an asymmetric double-stranded structure having separate polynucleotide strands comprising sense and antisense regions, wherein the antisense region is about 18 to about 22 (e.g., about 18, 19, 20, 21, or 22) nucleotides in length and wherein the sense region is about 3 to about 15 (e.g., about 3, 4, 5, 6, 7, 8, 9, 10, 11, 12, 13, 14, or 15) nucleotides in length, wherein the sense region the antisense region have at least 3 complementary nucleotides, and wherein the siNA can include one or more chemical modifications comprising a structure having any of Formulae I-VII or any combination thereof. In another embodiment, the asymmetric double-stranded siNA molecule can also have a 5'-terminal phosphate group that can be chemically modified as described herein (for example a 5'-terminal phosphate group having Formula IV).

In another embodiment, an siNA molecule of the invention comprises a circular nucleic acid molecule, wherein the siNA is about 38 to about 70 (e.g., about 38, 40, 45, 50, 55, 60, 65, or 70) nucleotides in length having about 18 to about 23 (e.g., about 18, 19, 20, 21, 22, or 23) base pairs, and wherein the siNA can include a chemical modification, which comprises a structure having any of Formulae I-VII or any combination thereof. For example, an exemplary chemically-modified siNA molecule of the invention comprises a circular oligonucleotide having about 42 to about 50 (e.g., about 42, 43, 44, 45, 46, 47, 48, 49, or 50) nucleotides that is chemically-modified with a chemical modification having any of Formulae I-VII or any combination thereof, wherein the circular oligonucleotide forms a dumbbell shaped structure having about 19 base pairs and 2 loops.

In another embodiment, a circular siNA molecule of the invention contains two loop motifs, wherein one or both loop portions of the siNA molecule is biodegradable. For example, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In one embodiment, an siNA molecule of the invention comprises at least one (e.g., about 1, 2, 3, 4, 5, 6, 7, 8, 9, 10, or more) abasic moiety, for example a compound having Formula V:

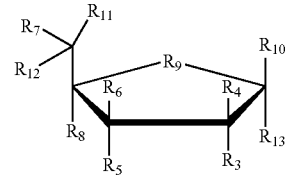

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-5-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; and R9 is O, S, CH2, S=O, CHF, or CF2.

In one embodiment, an siNA molecule of the invention comprises at least one (e.g., about 1, 2, 3, 4, 5, 6, 7, 8, 9, 10, or more) inverted abasic moiety, for example a compound having Formula VI:

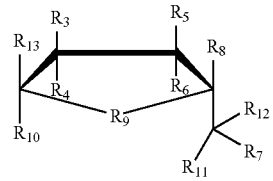

wherein each R3, R4, R5, R6, R7, R8, R10, R11, R12, and R13 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-5-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or group having Formula I or II; R9 is O, S, CH2, S=O, CHF, or CF2, and either R5, R3, R8 or R13 serves as a point of attachment to the siNA molecule of the invention.

In another embodiment, an siNA molecule of the invention comprises at least one (e.g., about 1, 2, 3, 4, 5, 6, 7, 8, 9, 10, or more) substituted polyalkyl moieties, for example a compound having Formula VII:

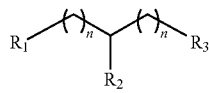

wherein each n is independently an integer from 1 to 12, each R1, R2 and R3 is independently H, OH, alkyl, substituted alkyl, alkaryl or aralkyl, F, Cl, Br, CN, CF3, OCF3, OCN, O-alkyl, S-alkyl, N-alkyl, O-alkenyl, S-alkenyl, N-alkenyl, SO-alkyl, alkyl-SH, alkyl-OH, O-alkyl-OH, O-alkyl-SH, S-alkyl-OH, S-alkyl-SH, alkyl-5-alkyl, alkyl-O-alkyl, ONO2, NO2, N3, NH2, aminoalkyl, aminoacid, aminoacyl, ONH2, O-aminoalkyl, O-aminoacid, O-aminoacyl, heterocycloalkyl, heterocycloalkaryl, aminoalkylamino, polyalkylamino, substituted silyl, or a group having Formula I, and R1, R2 or R3 serves as points of attachment to the siNA molecule of the invention.

In another embodiment, the invention features a compound having Formula VII, wherein R1 and R2 are hydroxyl (OH) groups, n=1, and R3 comprises O and is the point of attachment to the 3'-end, the 5'-end, or both of the 3' and 5'-ends of one or both strands of a double-stranded siNA molecule of the invention or to a single-stranded siNA molecule of the invention. This modification is referred to herein as "glyceryl" (for example modification 6 in FIG. 10).

In another embodiment, a moiety having any of Formula V, VI or VII of the invention is at the 3'-end, the 5'-end, or both of the 3' and 5'-ends of an siNA molecule of the invention. For example, a moiety having Formula V, VI or VII can be present at the 3'-end, the 5'-end, or both of the 3' and 5'-ends of the antisense strand, the sense strand, or both antisense and sense strands of the siNA molecule. In addition, a moiety having Formula VII can be present at the 3'-end or the 5'-end of a hairpin siNA molecule as described herein.

In another embodiment, an siNA molecule of the invention comprises an abasic residue having Formula V or VI, wherein the abasic residue having Formula VI or VI is connected to the siNA construct in a 3'-3',3'-2',2'-3', or 5'-5' configuration, such as at the 3'-end, the 5'-end, or both of the 3' and 5'-ends of one or both siNA strands.

In one embodiment, an siNA molecule of the invention comprises one or more (e.g., about 1, 2, 3, 4, 5, 6, 7, 8, 9, 10, or more) locked nucleic acid (LNA) nucleotides, for example at the 5'-end, the 3'-end, both of the 5' and 3'-ends, or any combination thereof, of the siNA molecule.

In another embodiment, an siNA molecule of the invention comprises one or more (e.g., about 1, 2, 3, 4, 5, 6, 7, 8, 9, 10, or more) acyclic nucleotides, for example at the 5'-end, the 3'-end, both of the 5' and 3'-ends, or any combination thereof, of the siNA molecule.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the sense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically-modified short interfering nucleic acid (siNA) molecule of the invention comprising a sense region, wherein any (e.g., one or more or all) pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), wherein any (e.g., one or more or all) purine nucleotides present in the sense region are 2'-O-methyl purine nucleotides (e.g., wherein all purine nucleotides are 2'-O-methyl purine nucleotides or alternately a plurality of purine nucleotides are 2'-O-methyl purine nucleotides), and wherein any nucleotides comprising a 3'-terminal nucleotide overhang that are present in said sense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), and wherein any nucleotides comprising a 3'-terminal nucleotide overhang that are present in said antisense region are 2'-deoxy nucleotides.

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-deoxy purine nucleotides (e.g., wherein all purine nucleotides are 2'-deoxy purine nucleotides or alternately a plurality of purine nucleotides are 2'-deoxy purine nucleotides).

In one embodiment, the invention features a chemically-modified short interfering nucleic acid (siNA) molecule of the invention comprising an antisense region, wherein any (e.g., one or more or all) pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any (e.g., one or more or all) purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides).

In one embodiment, the invention features a chemically-modified short interfering nucleic acid (siNA) molecule of the invention capable of mediating RNA interference (RNAi) against interleukin and/or interleukin receptor inside a cell or reconstituted in vitro system comprising a sense region, wherein one or more pyrimidine nucleotides present in the sense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the sense region are 2'-deoxy purine nucleotides (e.g., wherein all purine nucleotides are 2'-deoxy purine nucleotides or alternately a plurality of purine nucleotides are 2'-deoxy purine nucleotides), and an antisense region, wherein one or more pyrimidine nucleotides present in the antisense region are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). The sense region and/or the antisense region can have a terminal cap modification, such as any modification described herein or shown in FIG. 10, that is optionally present at the 3'-end, the 5'-end, or both of the 3' and 5'-ends of the sense and/or antisense sequence. The sense and/or antisense region can optionally further comprise a 3'-terminal nucleotide overhang having about 1 to about 4 (e.g., about 1, 2, 3, or 4) 2'-deoxynucleotides. The overhang nucleotides can further comprise one or more (e.g., about 1, 2, 3, 4 or more) phosphorothioate, phosphonoacetate, and/or thiophosphonoacetate internucleotide linkages. Non-limiting examples of these chemically-modified siNAs are shown in FIGS. 4 and 5 and Tables III and IV herein. In any of these described embodiments, the purine nucleotides present in the sense region are alternatively 2'-O-methyl purine nucleotides (e.g., wherein all purine nucleotides are 2'-O-methyl purine nucleotides or alternately a plurality of purine nucleotides are 2'-O-methyl purine nucleotides) and one or more purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). Also, in any of these embodiments, one or more purine nucleotides present in the sense region are alternatively purine ribonucleotides (e.g., wherein all purine nucleotides are purine ribonucleotides or alternately a plurality of purine nucleotides are purine ribonucleotides) and any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides). Additionally, in any of these embodiments, one or more purine nucleotides present in the sense region and/or present in the antisense region are alternatively selected from the group consisting of 2'-deoxy nucleotides, locked nucleic acid (LNA) nucleotides, 2'-methoxyethyl nucleotides, 4'-thionucleotides, and 2'-O-methyl nucleotides (e.g., wherein all purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides or alternately a plurality of purine nucleotides are selected from the group consisting of 2'-deoxy nucleotides, locked nucleic acid (LNA) nucleotides, 2'-methoxyethyl nucleotides, 4'-thionucleotides, and 2'-O-methyl nucleotides).

In another embodiment, any modified nucleotides present in the siNA molecules of the invention, preferably in the antisense strand of the siNA molecules of the invention, but also optionally in the sense and/or both antisense and sense strands, comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984). As such, chemically modified nucleotides present in the siNA molecules of the invention, preferably in the antisense strand of the siNA molecules of the invention, but also optionally in the sense and/or both antisense and sense strands, are resistant to nuclease degradation while at the same time maintaining the capacity to mediate RNAi. Non-limiting examples of nucleotides having a Northern configuration include locked nucleic acid (LNA) nucleotides (e.g., 2'-O, 4'-C-methylene-(D-ribofuranosyl)nucleotides); 2'-methoxyethoxy (MOE) nucleotides; 2'-methyl-thio-ethyl, 2'-deoxy-2'-fluoro nucleotides, 2'-deoxy-2'-chloro nucleotides, 2'-azido nucleotides, and 2'-O-methyl nucleotides.

In one embodiment, the sense strand of a double-stranded siNA molecule of the invention comprises a terminal cap moiety, (see for example FIG. 10) such as an inverted deoxyabasic moiety, at the 3'-end, 5'-end, or both 3' and 5'-ends of the sense strand.

In one embodiment, the invention features a chemically-modified short interfering nucleic acid molecule (siNA) capable of mediating RNA interference (RNAi) against interleukin and/or interleukin receptor inside a cell or reconstituted in vitro system, wherein the chemical modification comprises a conjugate covalently attached to the chemically-modified siNA molecule. Non-limiting examples of conjugates contemplated by the invention include conjugates and ligands described in Vargeese et al., U.S. Ser. No. 10/427,160, filed Apr. 30, 2003, incorporated by reference herein in its entirety, including the drawings. In another embodiment, the conjugate is covalently attached to the chemically-modified siNA molecule via a biodegradable linker. In one embodiment, the conjugate molecule is attached at the 3'-end of either the sense strand, the antisense strand, or both strands of the chemically-modified siNA molecule. In another embodiment, the conjugate molecule is attached at the 5'-end of either the sense strand, the antisense strand, or both strands of the chemically-modified siNA molecule. In yet another embodiment, the conjugate molecule is attached both the 3'-end and 5'-end of either the sense strand, the antisense strand, or both strands of the chemically-modified siNA molecule, or any combination thereof. In one embodiment, a conjugate molecule of the invention comprises a molecule that facilitates delivery of a chemically-modified siNA molecule into a biological system, such as a cell. In another embodiment, the conjugate molecule attached to the chemically-modified siNA molecule is a polyethylene glycol, human serum albumin, or a ligand for a cellular receptor that can mediate cellular uptake. Examples of specific conjugate molecules contemplated by the instant invention that can be attached to chemically-modified siNA molecules are described in Vargeese et al., U.S. Ser. No. 10/201,394, filed Jul. 22, 2002 incorporated by reference herein. The type of conjugates used and the extent of conjugation of siNA molecules of the invention can be evaluated for improved pharmacokinetic profiles, bioavailability, and/or stability of siNA constructs while at the same time maintaining the ability of the siNA to mediate RNAi activity. As such, one skilled in the art can screen siNA constructs that are modified with various conjugates to determine whether the siNA conjugate complex possesses improved properties while maintaining the ability to mediate RNAi, for example in animal models as are generally known in the art.

In one embodiment, the invention features a short interfering nucleic acid (siNA) molecule of the invention, wherein the siNA further comprises a nucleotide, non-nucleotide, or mixed nucleotide/non-nucleotide linker that joins the sense region of the siNA to the antisense region of the siNA. In one embodiment, a nucleotide linker of the invention can be a linker of $\geq 2$ nucleotides in length, for example about 3, 4, 5, 6, 7, 8, 9, or 10 nucleotides in length. In another embodiment, the nucleotide linker can be a nucleic acid aptamer. By "aptamer" or "nucleic acid aptamer" as used herein is meant a nucleic acid molecule that binds specifically to a target molecule wherein the nucleic acid molecule has a sequence that comprises a sequence recognized by the target molecule in its natural setting. Alternately, an aptamer can be a nucleic acid molecule that binds to a target molecule where the target molecule does not naturally bind to a nucleic acid. The target molecule can be any molecule of interest. For example, the aptamer can be used to bind to a ligand-binding domain of a protein, thereby preventing interaction of the naturally occurring ligand with the protein. This is a non-limiting example and those in the art will recognize that other embodiments can be readily generated using techniques generally known in the art. (See, for example, Gold et al., 1995, *Annu. Rev. Biochem.*, 64, 763; Brody and Gold, 2000, *J. Biotechnol.*, 74, 5; Sun, 2000, *Curr. Opin. Mol. Ther.*, 2, 100; Kusser, 2000, *J. Biotechnol.*, 74, 27; Hermann and Patel, 2000, *Science*, 287, 820; and Jayasena, 1999, *Clinical Chemistry*, 45, 1628.)

In yet another embodiment, a non-nucleotide linker of the invention comprises abasic nucleotide, polyether, polyamine, polyamide, peptide, carbohydrate, lipid, polyhydrocarbon, or other polymeric compounds (e.g. polyethylene glycols such as those having between 2 and 100 ethylene glycol units). Specific examples include those described by Seela and Kaiser, *Nucleic Acids Res.* 1990, 18:6353 and *Nucleic Acids Res.* 1987, 15:3113; Cload and Schepartz, *J. Am. Chem. Soc.* 1991, 113:6324; Richardson and Schepartz, *J. Am. Chem. Soc.* 1991, 113:5109; Ma et al., *Nucleic Acids Res.* 1993, 21:2585 and *Biochemisty* 1993, 32:1751; Durand et al., *Nucleic Acids Res.* 1990, 18:6353; McCurdy et al., *Nucleosides & Nucleotides* 1991, 10:287; Jschke et al., *Tetrahedron Lett.* 1993, 34:301; Ono et al., *Biochemistry* 1991, 30:9914; Arnold et al., International Publication No. WO 89/02439; Usman et al., International Publication No. WO 95/06731; Dudycz et al., International Publication No. WO 95/11910 and Ferentz and Verdine, *J. Am. Chem. Soc.* 1991, 113:4000, all hereby incorporated by reference herein. A "non-nucleotide" further means any group or compound that can be incorporated into a nucleic acid chain in the place of one or more nucleotide units, including either sugar and/or phosphate substitutions, and allows the remaining bases to exhibit their enzymatic activity. The group or compound can be abasic in that it does not contain a commonly recognized nucleotide base, such as adenosine, guanine, cytosine, uracil or thymine, for example at the C1 position of the sugar.

In one embodiment, the invention features a short interfering nucleic acid (siNA) molecule capable of mediating RNA interference (RNAi) inside a cell or reconstituted in vitro system, wherein one or both strands of the siNA molecule that are assembled from two separate oligonucleotides do not comprise any ribonucleotides. For example, an siNA molecule can be assembled from a single oligonucleotide where the sense and antisense regions of the siNA comprise separate oligonucleotides that do not have any ribonucleotides (e.g., nucleotides having a 2'-OH group) present in the oligonucleotides. In another example, an siNA molecule can be assembled from a single oligonucleotide where the sense and antisense regions of the siNA are linked or circularized by a nucleotide or non-nucleotide linker as described herein, wherein the oligonucleotide does not have any ribonucleotides (e.g., nucleotides having a 2'-OH group) present in the oligonucleotide. Applicant has surprisingly found that the presence of ribonucleotides (e.g., nucleotides having a 2'-hydroxyl group) within the siNA molecule is not required or essential to support RNAi activity. As such, in one embodiment, all positions within the siNA can include chemically modified nucleotides and/or non-nucleotides such as nucleotides and or non-nucleotides having Formula I, II, III, IV, V, VI, or VII or any combination thereof to the extent that the ability of the siNA molecule to support RNAi activity in a cell is maintained.

In one embodiment, an siNA molecule of the invention is a single-stranded siNA molecule that mediates RNAi activity in a cell or reconstituted in vitro system comprising a single-stranded polynucleotide having complementarity to a target nucleic acid sequence. In another embodiment, the single-stranded siNA molecule of the invention comprises a 5'-terminal phosphate group. In another embodiment, the single-stranded siNA molecule of the invention comprises a 5'-terminal phosphate group and a 3'-terminal phosphate group (e.g., a 2',3'-cyclic phosphate). In another embodiment, the single-stranded siNA molecule of the invention comprises about 19 to about 29 (e.g., about 19, 20, 21, 22, 23, 24, 25, 26, 27, 28, or 29) nucleotides. In yet another embodiment, the single-stranded siNA molecule of the invention comprises one or more chemically modified nucleotides or non-nucleotides described herein. For example, all the positions within the siNA molecule can include chemically-modified nucleotides such as nucleotides having any of Formulae I-VII, or any combination thereof to the extent that the ability of the siNA molecule to support RNAi activity in a cell is maintained.

In one embodiment, an siNA molecule of the invention is a single-stranded siNA molecule that mediates RNAi activity in a cell or reconstituted in vitro system comprising a single-stranded polynucleotide having complementarity to a target nucleic acid sequence, wherein one or more pyrimidine nucleotides present in the siNA are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the antisense region are 2'-O-methyl purine nucleotides (e.g., wherein all purine nucleotides are 2'-O-methyl purine nucleotides or alternately a plurality of purine nucleotides are 2'-O-methyl purine nucleotides), and a terminal cap modification, such as any modification described herein or shown in FIG. 10, that is optionally present at the 3'-end and/or the 5'-end. The siNA optionally further comprises about 1 to about 4 or more (e.g., about 1, 2, 3, 4 or more) terminal 2'-deoxynucleotides at the 3'-end of the siNA molecule, wherein the terminal nucleotides can further comprise one or more (e.g., 1, 2, 3, 4 or more) phosphorothioate, phosphonoacetate, and/or thiophosphonoacetate internucleotide linkages, and wherein the siNA optionally further comprises a terminal phosphate group, such as a 5'-terminal phosphate group. In any of these embodiments, any purine nucleotides present in the antisense region are alternatively 2'-deoxy purine nucleotides (e.g., wherein all purine nucleotides are 2'-deoxy purine nucleotides or alternately a plurality of purine nucleotides are 2'-deoxy purine nucleotides). Also, in any of these embodiments, any purine nucleotides present in the siNA (i.e., purine nucleotides present in the sense and/or antisense region) can alternatively be locked nucleic acid (LNA) nucleotides (e.g., wherein all purine nucleotides are LNA nucleotides or alternately a plurality of purine nucleotides are LNA nucleotides). Also, in any of these embodiments, any purine nucleotides present in the siNA are alternatively 2'-methoxyethyl purine nucleotides (e.g., wherein all purine nucleotides are 2'-methoxyethyl purine nucleotides or alternately a plurality of purine nucleotides are 2'-methoxyethyl purine nucleotides). In another embodiment, any modified nucleotides present in the single-stranded siNA molecules of the invention comprise modified nucleotides having properties or characteristics similar to naturally occurring ribonucleotides. For example, the invention features siNA molecules including modified nucleotides having a Northern conformation (e.g., Northern pseudorotation cycle, see for example Saenger, *Principles of Nucleic Acid Structure*, Springer-Verlag ed., 1984). As such, chemically modified nucleotides present in the single-stranded siNA molecules of the invention are preferably resistant to nuclease degradation while at the same time maintaining the capacity to mediate RNAi.

In one embodiment, the invention features a method for modulating the expression of a interleukin and/or interleukin receptor gene within a cell comprising: (a) synthesizing an siNA molecule of the invention, which can be chemically-modified, wherein one of the siNA strands comprises a sequence complementary to RNA of the interleukin and/or interleukin receptor gene; and (b) introducing the siNA molecule into a cell under conditions suitable to modulate the expression of the interleukin and/or interleukin receptor gene in the cell.

In one embodiment, the invention features a method for modulating the expression of a interleukin and/or interleukin receptor gene within a cell comprising: (a) synthesizing an siNA molecule of the invention, which can be chemically-modified, wherein one of the siNA strands comprises a sequence complementary to RNA of the interleukin and/or interleukin receptor gene and wherein the sense strand sequence of the siNA comprises a sequence identical or substantially similar to the sequence of the target RNA; and (b) introducing the siNA molecule into a cell under conditions suitable to modulate the expression of the interleukin and/or interleukin receptor gene in the cell.

In another embodiment, the invention features a method for modulating the expression of more than one interleukin and/or interleukin receptor gene within a cell comprising: (a) synthesizing siNA molecules of the invention, which can be chemically-modified, wherein one of the siNA strands comprises a sequence complementary to RNA of the interleukin and/or interleukin receptor genes; and (b) introducing the siNA molecules into a cell under conditions suitable to modulate the expression of the interleukin and/or interleukin receptor genes in the cell.

In another embodiment, the invention features a method for modulating the expression of two or more interleukin and/or interleukin receptor genes within a cell comprising: (a) synthesizing one or more siNA molecules of the invention, which can be chemically-modified, wherein the siNA strands comprise sequences complementary to RNA of the interleukin and/or interleukin receptor genes and wherein the sense strand sequences of the siNAs comprise sequences identical or substantially similar to the sequences of the target RNAs; and (b) introducing the siNA molecules into a cell under conditions suitable to modulate the expression of the interleukin and/or interleukin receptor genes in the cell.

In another embodiment, the invention features a method for modulating the expression of more than one interleukin and/or interleukin receptor gene within a cell comprising: (a) synthesizing an siNA molecule of the invention, which can be chemically-modified, wherein one of the siNA strands comprises a sequence complementary to RNA of the interleukin and/or interleukin receptor gene and wherein the sense strand sequence of the siNA comprises a sequence identical or substantially similar to the sequences of the target RNAs; and (b) introducing the siNA molecule into a cell under conditions suitable to modulate the expression of the interleukin and/or interleukin receptor genes in the cell.

In one embodiment, siNA molecules of the invention are used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain target cells from a patient are extracted. These extracted cells are contacted with siNAs targeting a specific nucleotide sequence within the cells under conditions suitable for uptake of the siNAs by these cells (e.g. using delivery reagents such as cationic lipids, liposomes and the like or using techniques such as electroporation to facilitate the delivery of siNAs into cells). The cells are then reintroduced back into the same patient or other patients. In one embodiment, the invention features a method of modulating the expression of a interleukin and/or interleukin receptor gene in a tissue explant comprising: (a) synthesizing an siNA molecule of the invention, which can be chemically-modified, wherein one of the siNA strands comprises a sequence complementary to RNA of the interleukin and/or interleukin receptor gene; and (b) introducing the siNA molecule into a cell of the tissue explant derived from a particular organism under conditions suitable to modulate the expression of the interleukin and/or interleukin receptor gene in the tissue explant. In another embodiment, the method further comprises introducing the tissue explant back into the organism the tissue was derived from or into another organism under conditions suitable to modulate the expression of the interleukin and/or interleukin receptor gene in that organism.

In one embodiment, the invention features a method of modulating the expression of a interleukin and/or interleukin receptor gene in a tissue explant comprising: (a) synthesizing an siNA molecule of the invention, which can be chemically-modified, wherein one of the siNA strands comprises a sequence complementary to RNA of the interleukin and/or interleukin receptor gene and wherein the sense strand sequence of the siNA comprises a sequence identical or substantially similar to the sequence of the target RNA; and (b) introducing the siNA molecule into a cell of the tissue explant derived from a particular organism under conditions suitable to modulate the expression of the interleukin and/or interleukin receptor gene in the tissue explant. In another embodiment, the method further comprises introducing the tissue explant back into the organism the tissue was derived from or into another organism under conditions suitable to modulate the expression of the interleukin and/or interleukin receptor gene in that organism.

In another embodiment, the invention features a method of modulating the expression of more than one interleukin and/or interleukin receptor gene in a tissue explant comprising: (a) synthesizing siNA molecules of the invention, which can be chemically-modified, wherein one of the siNA strands comprises a sequence complementary to RNA of the interleukin and/or interleukin receptor genes; and (b) introducing the siNA molecules into a cell of the tissue explant derived from a particular organism under conditions suitable to modulate the expression of the interleukin and/or interleukin receptor genes in the tissue explant. In another embodiment, the method further comprises introducing the tissue explant back into the organism the tissue was derived from or into another organism under conditions suitable to modulate the expression of the interleukin and/or interleukin receptor genes in that organism.

In one embodiment, the invention features a method of modulating the expression of a interleukin and/or interleukin receptor gene in an organism comprising: (a) synthesizing an siNA molecule of the invention, which can be chemically-modified, wherein one of the siNA strands comprises a sequence complementary to RNA of the interleukin and/or interleukin receptor gene; and (b) introducing the siNA molecule into the organism under conditions suitable to modulate the expression of the interleukin and/or interleukin receptor gene in the organism. The level of interleukin and/or interleukin receptor protein or RNA can be determined as is known in the art.

In another embodiment, the invention features a method of modulating the expression of more than one interleukin and/or interleukin receptor gene in an organism comprising: (a) synthesizing siNA molecules of the invention, which can be chemically-modified, wherein one of the siNA strands comprises a sequence complementary to RNA of the interleukin and/or interleukin receptor genes; and (b) introducing the siNA molecules into the organism under conditions suitable to modulate the expression of the interleukin and/or interleukin receptor genes in the organism. The level of interleukin and/or interleukin receptor protein or RNA can be determined as is known in the art.

In one embodiment, the invention features a method for modulating the expression of a interleukin and/or interleukin receptor gene within a cell comprising: (a) synthesizing an siNA molecule of the invention, which can be chemically-modified, wherein the siNA comprises a single-stranded sequence having complementarity to RNA of the interleukin and/or interleukin receptor gene; and (b) introducing the siNA molecule into a cell under conditions suitable to modulate the expression of the interleukin and/or interleukin receptor gene in the cell.

In another embodiment, the invention features a method for modulating the expression of more than one interleukin and/or interleukin receptor gene within a cell comprising: (a) synthesizing siNA molecules of the invention, which can be chemically-modified, wherein the siNA comprises a single-stranded sequence having complementarity to RNA of the interleukin and/or interleukin receptor gene; and (b) contacting the cell in vitro or in vivo with the siNA molecule under conditions suitable to modulate the expression of the interleukin and/or interleukin receptor genes in the cell.

In one embodiment, the invention features a method of modulating the expression of a interleukin and/or interleukin receptor gene in a tissue explant comprising: (a) synthesizing an siNA molecule of the invention, which can be chemically-modified, wherein the siNA comprises a single-stranded sequence having complementarity to RNA of the interleukin and/or interleukin receptor gene; and (b) contacting the cell of the tissue explant derived from a particular organism with the siNA molecule under conditions suitable to modulate the expression of the interleukin and/or interleukin receptor gene in the tissue explant. In another embodiment, the method further comprises introducing the tissue explant back into the organism the tissue was derived from or into another organism under conditions suitable to modulate the expression of the interleukin and/or interleukin receptor gene in that organism.

In another embodiment, the invention features a method of modulating the expression of more than one interleukin and/or interleukin receptor gene in a tissue explant comprising: (a) synthesizing siNA molecules of the invention, which can be chemically-modified, wherein the siNA comprises a single-stranded sequence having complementarity to RNA of the interleukin and/or interleukin receptor gene; and (b) introducing the siNA molecules into a cell of the tissue explant derived from a particular organism under conditions suitable to modulate the expression of the interleukin and/or interleukin receptor genes in the tissue explant. In another embodiment, the method further comprises introducing the tissue explant back into the organism the tissue was derived from or into another organism under conditions suitable to modulate the expression of the interleukin and/or interleukin receptor genes in that organism.

In one embodiment, the invention features a method of modulating the expression of a interleukin and/or interleukin receptor gene in an organism comprising: (a) synthesizing an siNA molecule of the invention, which can be chemically-modified, wherein the siNA comprises a single-stranded sequence having complementarity to RNA of the interleukin and/or interleukin receptor gene; and (b) introducing the siNA molecule into the organism under conditions suitable to modulate the expression of the interleukin and/or interleukin receptor gene in the organism.

In another embodiment, the invention features a method of modulating the expression of more than one interleukin and/or interleukin receptor gene in an organism comprising: (a) synthesizing siNA molecules of the invention, which can be chemically-modified, wherein the siNA comprises a single-stranded sequence having complementarity to RNA of the interleukin and/or interleukin receptor gene; and (b) introducing the siNA molecules into the organism under conditions suitable to modulate the expression of the interleukin and/or interleukin receptor genes in the organism.

In one embodiment, the invention features a method of modulating the expression of a interleukin and/or interleukin receptor gene in an organism comprising contacting the organism with an siNA molecule of the invention under conditions suitable to modulate the expression of the interleukin and/or interleukin receptor gene in the organism.

In one embodiment, the invention features a method for treating or preventing a disease, condition, trait, genotype or phenotype in a subject, comprising administering to the subject a composition of the invention under conditions suitable for the treatment or prevention of the disease, condition, trait, genotype or phenotype in the subject, alone or in conjunction with one or more other therapeutic compounds. In yet another embodiment, the invention features a method for reducing or preventing tissue rejection in a subject comprising administering to the subject a composition of the invention under conditions suitable for the reduction or prevention of tissue rejection in the subject.

In one embodiment, the invention features a method for treating an inflammatory disease or condition in an organism comprising contacting the organism with an siNA molecule of the invention under conditions suitable to modulate the expression of the interleukin and/or interleukin receptor gene in the organism.

In one embodiment, the invention features a method for treating or preventing an allergic reaction, disease, or condition in an organism comprising contacting the organism with an siNA molecule of the invention under conditions suitable to modulate the expression of the interleukin and/or interleukin receptor gene in the organism.

In one embodiment, the invention features a method for treating or preventing an autoimmune disease or condition in an organism comprising contacting the organism with an siNA molecule of the invention under conditions suitable to modulate the expression of the interleukin and/or interleukin receptor gene in the organism.

In one embodiment, the invention features a method for treating or preventing cancer in an organism comprising contacting the organism with an siNA molecule of the invention under conditions suitable to modulate the expression of the interleukin and/or interleukin receptor gene in the organism.

In one embodiment, the invention features a method for treating or preventing a respiratory disease or condition in an organism comprising contacting the organism with an siNA molecule of the invention under conditions suitable to modulate the expression of the interleukin and/or interleukin receptor gene in the organism.

In one embodiment, the invention features a method for treating or preventing a pulmonary disease or condition in an organism comprising contacting the organism with an siNA molecule of the invention under conditions suitable to modulate the expression of the interleukin and/or interleukin receptor gene in the organism.

In one embodiment, the invention features a method for treating or preventing a neurodegenerative or neurological disease or condition in an organism comprising contacting the organism with an siNA molecule of the invention under conditions suitable to modulate the expression of the interleukin and/or interleukin receptor gene in the organism.

In one embodiment, the invention features a method for treating or preventing a proliferative disease or condition in an organism comprising contacting the organism with an siNA molecule of the invention under conditions suitable to modulate the expression of the interleukin and/or interleukin receptor gene in the organism.

In one embodiment, the invention features a method for treating or preventing a cardiovascular disease or condition in an organism comprising contacting the organism with an siNA molecule of the invention under conditions suitable to modulate the expression of the interleukin and/or interleukin receptor gene in the organism.

In one embodiment, the invention features a method for treating or preventing a renal disease or condition in an organism comprising contacting the organism with an siNA molecule of the invention under conditions suitable to modulate the expression of the interleukin and/or interleukin receptor gene in the organism.

In one embodiment, the invention features a method for treating or preventing a ocular disease or condition in an organism comprising contacting the organism with an siNA molecule of the invention under conditions suitable to modulate the expression of the interleukin and/or interleukin receptor gene in the organism.

In one embodiment, the invention features a method for treating or preventing viral disease or infection in an organism comprising contacting the organism with an siNA molecule of the invention under conditions suitable to modulate the expression of the interleukin and/or interleukin receptor gene in the organism.

The nucleic acid molecules of the instant invention, individually, or in combination or in conjunction with other drugs, can be used to treat diseases or conditions discussed herein (e.g., cancers and other proliferative conditions, viral infection, inflammatory disease, autoimmunity, respiratory disease, pulmonary disease, cardiovascular disease, neurological disease, renal disease, ocular disease, etc.). For example, to treat a particular disease, condition, trait, genotype or phenotype, the siNA molecules can be administered to a subject or can be administered to other appropriate cells evident to those skilled in the art, individually or in combination with one or more drugs under conditions suitable for the treatment.

In another embodiment, the invention features a method of modulating the expression of more than one interleukin (e.g., any IL-1 through IL-27) and/or interleukin receptor (e.g., any IL-1R through IL-27R) genes in an organism comprising contacting the organism with one or more siNA molecules of the invention under conditions suitable to modulate the expression of the interleukin and/or interleukin receptor genes in the organism.

The siNA molecules of the invention can be designed to down regulate or inhibit target (e.g., interleukin and/or interleukin receptor) gene expression through RNAi targeting of a variety of RNA molecules. In one embodiment, the siNA molecules of the invention are used to target various RNAs corresponding to a target gene. Non-limiting examples of such RNAs include messenger RNA (mRNA), alternate RNA splice variants of target gene(s), post-transcriptionally modified RNA of target gene(s), pre-mRNA of target gene(s), and/or RNA templates. If alternate splicing produces a family of transcripts that are distinguished by usage of appropriate exons, the instant invention can be used to inhibit gene expression through the appropriate exons to specifically inhibit or to distinguish among the functions of gene family members. For example, a protein that contains an alternatively spliced transmembrane domain can be expressed in both membrane bound and secreted forms. Use of the invention to target the exon containing the transmembrane domain can be used to determine the functional consequences of pharmaceutical targeting of membrane bound as opposed to the secreted form of the protein. Non-limiting examples of applications of the invention relating to targeting these RNA molecules include therapeutic pharmaceutical applications, pharmaceutical discovery applications, molecular diagnostic and gene function applications, and gene mapping, for example using single nucleotide polymorphism mapping with siNA molecules of the invention. Such applications can be implemented using known gene sequences or from partial sequences available from an expressed sequence tag (EST).

In another embodiment, the siNA molecules of the invention are used to target conserved sequences corresponding to a gene family or gene families such as interleukin and/or interleukin receptor family genes. As such, siNA molecules targeting multiple interleukin and/or interleukin receptor targets can provide increased therapeutic effect. In addition, siNA can be used to characterize pathways of gene function in a variety of applications. For example, the present invention can be used to inhibit the activity of target gene(s) in a pathway to determine the function of uncharacterized gene(s) in gene function analysis, mRNA function analysis, or translational analysis. The invention can be used to determine potential target gene pathways involved in various diseases and conditions toward pharmaceutical development. The invention can be used to understand pathways of gene expression involved in, for example, respiratory disease.

In one embodiment, siNA molecule(s) and/or methods of the invention are used to down regulate the expression of gene(s) that encode RNA referred to by Genbank Accession Nos., for example interleukin and/or interleukin receptor genes encoding RNA sequence(s) referred to herein by Genbank Accession number, for example, Genbank Accession Nos. shown in Table I.

In one embodiment, the invention features a method comprising: (a) generating a library of siNA constructs having a predetermined complexity; and (b) assaying the siNA constructs of (a) above, under conditions suitable to determine RNAi target sites within the target RNA sequence. In one embodiment, the siNA molecules of (a) have strands of a fixed length, for example, about 23 nucleotides in length. In another embodiment, the siNA molecules of (a) are of differing length, for example having strands of about 19 to about 25 (e.g., about 19, 20, 21, 22, 23, 24, or 25) nucleotides in length. In one embodiment, the assay can comprise a reconstituted in vitro siNA assay as described herein. In another embodiment, the assay can comprise a cell culture system in which target RNA is expressed. In another embodiment, fragments of target RNA are analyzed for detectable levels of cleavage, for example by gel electrophoresis, Northern blot analysis, or RNAse protection assays, to determine the most suitable target site(s) within the target RNA sequence. The target RNA sequence can be obtained as is known in the art, for example, by cloning and/or transcription for in vitro systems, and by cellular expression in in vivo systems.

In one embodiment, the invention features a method comprising: (a) generating a randomized library of siNA constructs having a predetermined complexity, such as of $4^N$, where N represents the number of base paired nucleotides in each of the siNA construct strands (e.g., for an siNA construct having 21 nucleotide sense and antisense strands with 19 base pairs, the complexity would be $4^{19}$); and (b) assaying the siNA constructs of (a) above, under conditions suitable to determine RNAi target sites within the target interleukin and/or interleukin receptor RNA sequence. In another embodiment, the siNA molecules of (a) have strands of a fixed length, for example about 23 nucleotides in length. In yet another embodiment, the siNA molecules of (a) are of differing length, for example having strands of about 19 to about 25 (e.g., about 19, 20, 21, 22, 23, 24, or 25) nucleotides in length. In one embodiment, the assay can comprise a reconstituted in vitro siNA assay as described in Example 6 herein. In another embodiment, the assay can comprise a cell culture system in which target RNA is expressed. In another embodiment, fragments of interleukin and/or interleukin receptor RNA are analyzed for detectable levels of cleavage, for example by gel electrophoresis, Northern blot analysis, or RNAse protection assays, to determine the most suitable target site(s) within the target interleukin and/or interleukin receptor RNA sequence. The target interleukin and/or interleukin receptor RNA sequence can be obtained as is known in the art, for example, by cloning and/or transcription for in vitro systems, and by cellular expression in in vivo systems.

In another embodiment, the invention features a method comprising: (a) analyzing the sequence of a RNA target encoded by a target gene; (b) synthesizing one or more sets of siNA molecules having sequence complementary to one or more regions of the RNA of (a); and (c) assaying the siNA molecules of (b) under conditions suitable to determine RNAi targets within the target RNA sequence. In one embodiment, the siNA molecules of (b) have strands of a fixed length, for example about 23 nucleotides in length. In another embodiment, the siNA molecules of (b) are of differing length, for example having strands of about 19 to about 25 (e.g., about 19, 20, 21, 22, 23, 24, or 25) nucleotides in length. In one embodiment, the assay can comprise a reconstituted in vitro siNA assay as described herein. In another embodiment, the assay can comprise a cell culture system in which target RNA is expressed. Fragments of target RNA are analyzed for detectable levels of cleavage, for example by gel electrophoresis, Northern blot analysis, or RNAse protection assays, to determine the most suitable target site(s) within the target RNA sequence. The target RNA sequence can be obtained as is known in the art, for example, by cloning and/or transcription for in vitro systems, and by expression in in vivo systems.

By "target site" is meant a sequence within a target RNA that is "targeted" for cleavage mediated by an siNA construct which contains sequences within its antisense region that are complementary to the target sequence.

By "detectable level of cleavage" is meant cleavage of target RNA (and formation of cleaved product RNAs) to an extent sufficient to discern cleavage products above the background of RNAs produced by random degradation of the target RNA. Production of cleavage products from 1-5% of the target RNA is sufficient to detect above the background for most methods of detection.

In one embodiment, the invention features a composition comprising an siNA molecule of the invention, which can be chemically-modified, in a pharmaceutically acceptable carrier or diluent. In another embodiment, the invention features a pharmaceutical composition comprising siNA molecules of the invention, which can be chemically-modified, targeting one or more genes in a pharmaceutically acceptable carrier or diluent. In another embodiment, the invention features a method for diagnosing a disease or condition in a subject comprising administering to the subject a composition of the invention under conditions suitable for the diagnosis of the disease or condition in the subject. In another embodiment, the invention features a method for treating or preventing a disease or condition in a subject, comprising administering to the subject a composition of the invention under conditions suitable for the treatment or prevention of the disease or condition in the subject, alone or in conjunction with one or more other therapeutic compounds. In yet another embodiment, the invention features a method for reducing or preventing, for example, respiratory disease (e.g., asthma) in a subject, comprising administering to the subject a composition of the invention under conditions suitable for the reduction or prevention of the respiratory disease in the subject.

In another embodiment, the invention features a method for validating a interleukin and/or interleukin receptor gene target, comprising: (a) synthesizing an siNA molecule of the invention, which can be chemically-modified, wherein one of the siNA strands includes a sequence complementary to RNA of a interleukin and/or interleukin receptor target gene; (b) introducing the siNA molecule into a cell, tissue, or organism under conditions suitable for modulating expression of the interleukin and/or interleukin receptor target gene in the cell, tissue, or organism; and (c) determining the function of the gene by assaying for any phenotypic change in the cell, tissue, or organism.

In another embodiment, the invention features a method for validating a interleukin and/or interleukin receptor target comprising: (a) synthesizing an siNA molecule of the invention, which can be chemically-modified, wherein one of the siNA strands includes a sequence complementary to RNA of a interleukin and/or interleukin receptor target gene; (b) introducing the siNA molecule into a biological system under conditions suitable for modulating expression of the interleukin and/or interleukin receptor target gene in the biological system; and (c) determining the function of the gene by assaying for any phenotypic change in the biological system.

By "biological system" is meant, material, in a purified or unpurified form, from biological sources, including but not limited to human or animal, wherein the system comprises the components required for RNAi activity. The term "biological system" includes, for example, a cell, tissue, or organism, or extract thereof. The term biological system also includes reconstituted RNAi systems that can be used in an in vitro setting.

By "phenotypic change" is meant any detectable change to a cell that occurs in response to contact or treatment with a nucleic acid molecule of the invention (e.g., siNA). Such detectable changes include, but are not limited to, changes in shape, size, proliferation, motility, protein expression or RNA expression or other physical or chemical changes as can be assayed by methods known in the art. The detectable change can also include expression of reporter genes/molecules such as Green Florescent Protein (GFP) or various tags that are used to identify an expressed protein or any other cellular component that can be assayed.

In one embodiment, the invention features a kit containing an siNA molecule of the invention, which can be chemically-modified, that can be used to modulate the expression of a interleukin and/or interleukin receptor target gene in a biological system, including, for example, in a cell, tissue, or organism. In another embodiment, the invention features a kit containing more than one siNA molecule of the invention, which can be chemically-modified, that can be used to modulate the expression of more than one interleukin and/or interleukin receptor target gene in a biological system, including, for example, in a cell, tissue, or organism.

In one embodiment, the invention features a cell containing one or more siNA molecules of the invention, which can be chemically-modified. In another embodiment, the cell containing an siNA molecule of the invention is a mammalian cell. In yet another embodiment, the cell containing an siNA molecule of the invention is a human cell.

In one embodiment, the synthesis of an siNA molecule of the invention, which can be chemically-modified, comprises: (a) synthesis of two complementary strands of the siNA molecule; (b) annealing the two complementary strands together under conditions suitable to obtain a double-stranded siNA molecule. In another embodiment, synthesis of the two complementary strands of the siNA molecule is by solid phase oligonucleotide synthesis. In yet another embodiment, synthesis of the two complementary strands of the siNA molecule is by solid phase tandem oligonucleotide synthesis.

In one embodiment, the invention features a method for synthesizing an siNA duplex molecule comprising: (a) synthesizing a first oligonucleotide sequence strand of the siNA molecule, wherein the first oligonucleotide sequence strand comprises a cleavable linker molecule that can be used as a scaffold for the synthesis of the second oligonucleotide sequence strand of the siNA; (b) synthesizing the second oligonucleotide sequence strand of siNA on the scaffold of the first oligonucleotide sequence strand, wherein the second oligonucleotide sequence strand further comprises a chemical moiety than can be used to purify the siNA duplex; (c) cleaving the linker molecule of (a) under conditions suitable for the two siNA oligonucleotide strands to hybridize and form a stable duplex; and (d) purifying the siNA duplex utilizing the chemical moiety of the second oligonucleotide sequence strand.

In one embodiment, cleavage of the linker molecule in (c) above takes place during deprotection of the oligonucleotide, for example under hydrolysis conditions using an alkylamine base such as methylamine. In one embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity as the solid support derivatized linker, such that cleavage of the solid support derivatized linker and the cleavable linker of (a) takes place concomitantly. In another embodiment, the chemical moiety of (b) that can be used to isolate the attached oligonucleotide sequence comprises a trityl group, for example a dimethoxytrityl group, which can be employed in a trityl-on synthesis strategy as described herein. In yet another embodiment, the chemical moiety, such as a dimethoxytrityl group, is removed during purification, for example, using acidic conditions.

In a further embodiment, the method for siNA synthesis is a solution phase synthesis or hybrid phase synthesis wherein both strands of the siNA duplex are synthesized in tandem using a cleavable linker attached to the first sequence which acts a scaffold for synthesis of the second sequence. Cleavage of the linker under conditions suitable for hybridization of the separate siNA sequence strands results in formation of the double-stranded siNA molecule.

In another embodiment, the invention features a method for synthesizing an siNA duplex molecule comprising: (a) synthesizing one oligonucleotide sequence strand of the siNA molecule, wherein the sequence comprises a cleavable linker molecule that can be used as a scaffold for the synthesis of another oligonucleotide sequence; (b) synthesizing a second oligonucleotide sequence having complementarity to the first sequence strand on the scaffold of (a), wherein the second sequence comprises the other strand of the double-stranded siNA molecule and wherein the second sequence further comprises a chemical moiety than can be used to isolate the attached oligonucleotide sequence; (c) purifying the product of (b) utilizing the chemical moiety of the second oligonucleotide sequence strand under conditions suitable for isolating the full-length sequence comprising both siNA oligonucleotide strands connected by the cleavable linker and under conditions suitable for the two siNA oligonucleotide strands to hybridize and form a stable duplex. In one embodiment, cleavage of the linker molecule in (c) above takes place during deprotection of the oligonucleotide, for example under hydrolysis conditions. In another embodiment, cleavage of the linker molecule in (c) above takes place after deprotection of the oligonucleotide. In another embodiment, the method of synthesis comprises solid phase synthesis on a solid support such as controlled pore glass (CPG) or polystyrene, wherein the first sequence of (a) is synthesized on a cleavable linker, such as a succinyl linker, using the solid support as a scaffold. The cleavable linker in (a) used as a scaffold for synthesizing the second strand can comprise similar reactivity or differing reactivity as the solid support derivatized linker, such that cleavage of the solid support derivatized linker and the cleavable linker of (a) takes place either concomitantly or sequentially. In one embodiment, the chemical moiety of (b) that can be used to isolate the attached oligonucleotide sequence comprises a trityl group, for example a dimethoxytrityl group.

In another embodiment, the invention features a method for making a double-stranded siNA molecule in a single synthetic process comprising: (a) synthesizing an oligonucleotide having a first and a second sequence, wherein the first sequence is complementary to the second sequence, and the first oligonucleotide sequence is linked to the second sequence via a cleavable linker, and wherein a terminal 5'-protecting group, for example, a 5'-O-dimethoxytrityl group (5'-O-DMT) remains on the oligonucleotide having the second sequence; (b) deprotecting the oligonucleotide whereby the deprotection results in the cleavage of the linker joining the two oligonucleotide sequences; and (c) purifying the product of (b) under conditions suitable for isolating the double-stranded siNA molecule, for example using a trityl-on synthesis strategy as described herein.

In another embodiment, the method of synthesis of siNA molecules of the invention comprises the teachings of Scaringe et al., U.S. Pat. Nos. 5,889,136; 6,008,400; and 6,111,086, incorporated by reference herein in their entirety.

In one embodiment, the invention features siNA constructs that mediate RNAi against interleukin and/or interleukin receptor, wherein the siNA construct comprises one or more chemical modifications, for example, one or more chemical modifications having any of Formulae I-VII or any combination thereof that increases the nuclease resistance of the siNA construct.

In another embodiment, the invention features a method for generating siNA molecules with increased nuclease resistance comprising (a) introducing nucleotides having any of Formula I-VII or any combination thereof into an siNA molecule, and (b) assaying the siNA molecule of step (a) under conditions suitable for isolating siNA molecules having increased nuclease resistance.

In one embodiment, the invention features siNA constructs that mediate RNAi against interleukin and/or interleukin receptor, wherein the siNA construct comprises one or more chemical modifications described herein that modulates the binding affinity between the sense and antisense strands of the siNA construct.

In another embodiment, the invention features a method for generating siNA molecules with increased binding affinity between the sense and antisense strands of the siNA molecule comprising (a) introducing nucleotides having any of Formula I-VII or any combination thereof into an siNA molecule, and (b) assaying the siNA molecule of step (a) under conditions suitable for isolating siNA molecules having increased binding affinity between the sense and antisense strands of the siNA molecule.

In one embodiment, the invention features siNA constructs that mediate RNAi against interleukin and/or interleukin receptor, wherein the siNA construct comprises one or more chemical modifications described herein that modulates the binding affinity between the antisense strand of the siNA construct and a complementary target RNA sequence within a cell.

In one embodiment, the invention features siNA constructs that mediate RNAi against interleukin and/or interleukin receptor, wherein the siNA construct comprises one or more chemical modifications described herein that modulates the binding affinity between the antisense strand of the siNA construct and a complementary target DNA sequence within a cell.

In another embodiment, the invention features a method for generating siNA molecules with increased binding affinity between the antisense strand of the siNA molecule and a complementary target RNA sequence comprising (a) introducing nucleotides having any of Formula I-VII or any combination thereof into an siNA molecule, and (b) assaying the siNA molecule of step (a) under conditions suitable for isolating siNA molecules having increased binding affinity between the antisense strand of the siNA molecule and a complementary target RNA sequence.

In another embodiment, the invention features a method for generating siNA molecules with increased binding affinity between the antisense strand of the siNA molecule and a complementary target DNA sequence comprising (a) introducing nucleotides having any of Formula I-VII or any combination thereof into an siNA molecule, and (b) assaying the siNA molecule of step (a) under conditions suitable for isolating siNA molecules having increased binding affinity between the antisense strand of the siNA molecule and a complementary target DNA sequence.

In one embodiment, the invention features siNA constructs that mediate RNAi against interleukin and/or interleukin receptor, wherein the siNA construct comprises one or more chemical modifications described herein that modulate the polymerase activity of a cellular polymerase capable of generating additional endogenous siNA molecules having sequence homology to the chemically-modified siNA construct.

In another embodiment, the invention features a method for generating siNA molecules capable of mediating increased polymerase activity of a cellular polymerase capable of generating additional endogenous siNA molecules having sequence homology to a chemically-modified siNA molecule comprising (a) introducing nucleotides having any of Formula I-VII or any combination thereof into an siNA molecule, and (b) assaying the siNA molecule of step (a) under conditions suitable for isolating siNA molecules capable of mediating increased polymerase activity of a cellular polymerase capable of generating additional endogenous siNA molecules having sequence homology to the chemically-modified siNA molecule.

In one embodiment, the invention features chemically-modified siNA constructs that mediate RNAi against interleukin and/or interleukin receptor in a cell, wherein the chemical modifications do not significantly effect the interaction of siNA with a target RNA molecule, DNA molecule and/or proteins or other factors that are essential for RNAi in a manner that would decrease the efficacy of RNAi mediated by such siNA constructs.

In another embodiment, the invention features a method for generating siNA molecules with improved RNAi activity against interleukin and/or interleukin receptor comprising (a) introducing nucleotides having any of Formula I-VII or any combination thereof into an siNA molecule, and (b) assaying the siNA molecule of step (a) under conditions suitable for isolating siNA molecules having improved RNAi activity.

In yet another embodiment, the invention features a method for generating siNA molecules with improved RNAi activity against interleukin and/or interleukin receptor target RNA comprising (a) introducing nucleotides having any of Formula I-VII or any combination thereof into an siNA molecule, and (b) assaying the siNA molecule of step (a) under conditions suitable for isolating siNA molecules having improved RNAi activity against the target RNA.

In yet another embodiment, the invention features a method for generating siNA molecules with improved RNAi activity against interleukin and/or interleukin receptor target DNA comprising (a) introducing nucleotides having any of Formula I-VII or any combination thereof into an siNA molecule, and (b) assaying the siNA molecule of step (a) under conditions suitable for isolating siNA molecules having improved RNAi activity against the target DNA.

In one embodiment, the invention features siNA constructs that mediate RNAi against interleukin and/or interleukin receptor, wherein the siNA construct comprises one or more chemical modifications described herein that modulates the cellular uptake of the siNA construct.

In another embodiment, the invention features a method for generating siNA molecules against interleukin and/or interleukin receptor with improved cellular uptake comprising (a) introducing nucleotides having any of Formula I-VII or any combination thereof into an siNA molecule, and (b) assaying the siNA molecule of step (a) under conditions suitable for isolating siNA molecules having improved cellular uptake.

In one embodiment, the invention features siNA constructs that mediate RNAi against interleukin and/or interleukin receptor, wherein the siNA construct comprises one or more chemical modifications described herein that increases the bioavailability of the siNA construct, for example, by attaching polymeric conjugates such as polyethyleneglycol or equivalent conjugates that improve the pharmacokinetics of the siNA construct, or by attaching conjugates that target specific tissue types or cell types in vivo. Non-limiting examples of such conjugates are described in Vargeese et al., U.S. Ser. No. 10/201,394 incorporated by reference herein.

In one embodiment, the invention features a method for generating siNA molecules of the invention with improved bioavailability, comprising (a) introducing a conjugate into the structure of an siNA molecule, and (b) assaying the siNA molecule of step (a) under conditions suitable for isolating siNA molecules having improved bioavailability. Such conjugates can include ligands for cellular receptors, such as peptides derived from naturally occurring protein ligands; protein localization sequences, including cellular ZIP code sequences; antibodies; nucleic acid aptamers; vitamins and other co-factors, such as folate and N-acetylgalactosamine; polymers, such as polyethyleneglycol (PEG); phospholipids; cholesterol; polyamines, such as spermine or spermidine; and others.

In one embodiment, the invention features a double-stranded short interfering nucleic acid (siNA) molecule that comprises a first nucleotide sequence complementary to a target RNA sequence or a portion thereof, and a second sequence having complementarity to said first sequence, wherein said second sequence is chemically modified in a manner that it can no longer act as a guide sequence for efficiently mediating RNA interference and/or be recognized by cellular proteins that facilitate RNAi.

In one embodiment, the invention features a double-stranded short interfering nucleic acid (siNA) molecule that comprises a first nucleotide sequence complementary to a target RNA sequence or a portion thereof, and a second sequence having complementarity to said first sequence, wherein the second sequence is designed or modified in a manner that prevents its entry into the RNAi pathway as a guide sequence or as a sequence that is complementary to a target nucleic acid (e.g., RNA) sequence. Such design or modifications are expected to enhance the activity of siNA and/or improve the specificity of siNA molecules of the invention. These modifications are also expected to minimize any off-target effects and/or associated toxicity.

In one embodiment, the invention features a double-stranded short interfering nucleic acid (siNA) molecule that comprises a first nucleotide sequence complementary to a target RNA sequence or a portion thereof, and a second sequence having complementarity to said first sequence, wherein said second sequence is incapable of acting as a guide sequence for mediating RNA interference.

In one embodiment, the invention features a double-stranded short interfering nucleic acid (siNA) molecule that comprises a first nucleotide sequence complementary to a target RNA sequence or a portion thereof, and a second sequence having complementarity to said first sequence, wherein said second sequence does not have a terminal 5'-hydroxyl (5'-OH) or 5'-phosphate group.

In one embodiment, the invention features a double-stranded short interfering nucleic acid (siNA) molecule that comprises a first nucleotide sequence complementary to a target RNA sequence or a portion thereof, and a second sequence having complementarity to said first sequence, wherein said second sequence comprises a terminal cap moiety at the 5'-end of said second sequence. In one embodiment, the terminal cap moiety comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a double-stranded short interfering nucleic acid (siNA) molecule that comprises a first nucleotide sequence complementary to a target RNA sequence or a portion thereof, and a second sequence having complementarity to said first sequence, wherein said second sequence comprises a terminal cap moiety at the 5'-end and 3'-end of said second sequence. In one embodiment, each terminal cap moiety individually comprises an inverted abasic, inverted deoxy abasic, inverted nucleotide moiety, a group shown in FIG. 10, an alkyl or cycloalkyl group, a heterocycle, or any other group that prevents RNAi activity in which the second sequence serves as a guide sequence or template for RNAi.

In one embodiment, the invention features a method for generating siNA molecules of the invention with improved specificity for down regulating or inhibiting the expression of a target nucleic acid (e.g., a DNA or RNA such as a gene or its corresponding RNA), comprising (a) introducing one or more chemical modifications into the structure of an siNA molecule, and (b) assaying the siNA molecule of step (a) under conditions suitable for isolating siNA molecules having improved specificity. In another embodiment, the chemical modification used to improve specificity comprises terminal cap modifications at the 5'-end, 3'-end, or both 5' and 3'-ends of the siNA molecule. The terminal cap modifications can comprise, for example, structures shown in FIG. 10 (e.g. inverted deoxyabasic moieties) or any other chemical modification that renders a portion of the siNA molecule (e.g. the sense strand) incapable of mediating RNA interference against an off target nucleic acid sequence. In a non-limiting example, an siNA molecule is designed such that only the antisense sequence of the siNA molecule can serve as a guide sequence for RISC mediated degradation of a corresponding target RNA sequence. This can be accomplished by rendering the sense sequence of the siNA inactive by introducing chemical modifications to the sense strand that preclude recognition of the sense strand as a guide sequence by RNAi machinery. In one embodiment, such chemical modifications comprise any chemical group at the 5'-end of the sense strand of the siNA, or any other group that serves to render the sense strand inactive as a guide sequence for mediating RNA interference. These modifications, for example, can result in a molecule where the 5'-end of the sense strand no longer has a free 5'-hydroxyl (5'-OH) or a free 5'-phosphate group (e.g., phosphate, diphosphate, triphosphate, cyclic phosphate etc.). Non-limiting examples of such siNA constructs are described herein, such as "Stab 9/10", "Stab 7/8", "Stab 7/19", "Stab 17/22", "Stab 23/24", and "Stab 24/25" chemistries and variants thereof (see Table IV) wherein the 5'-end and 3'-end of the sense strand of the siNA do not comprise a hydroxyl group or phosphate group.

In one embodiment, the invention features a method for generating siNA molecules of the invention with improved specificity for down regulating or inhibiting the expression of a target nucleic acid (e.g., a DNA or RNA such as a gene or its corresponding RNA), comprising introducing one or more chemical modifications into the structure of an siNA molecule that prevent a strand or portion of the siNA molecule from acting as a template or guide sequence for RNAi activity. In one embodiment, the inactive strand or sense region of the siNA molecule is the sense strand or sense region of the siNA molecule, i.e. the strand or region of the siNA that does not have complementarity to the target nucleic acid sequence. In one embodiment, such chemical modifications comprise any chemical group at the 5'-end of the sense strand or region of the siNA that does not comprise a 5'-hydroxyl (5'-OH) or 5'-phosphate group, or any other group that serves to render the sense strand or sense region inactive as a guide sequence for mediating RNA interference. Non-limiting examples of such siNA constructs are described herein, such as "Stab 9/10", "Stab 7/8", "Stab 7/19", "Stab 17/22", "Stab 23/24", and "Stab 24/25" chemistries and variants thereof (see Table IV) wherein the 5'-end and 3'-end of the sense strand of the siNA do not comprise a hydroxyl group or phosphate group.

In one embodiment, the invention features a method for screening siNA molecules that are active in mediating RNA interference against a target nucleic acid sequence comprising (a) generating a plurality of unmodified siNA molecules, (b) screening the siNA molecules of step (a) under conditions suitable for isolating siNA molecules that are active in mediating RNA interference against the target nucleic acid sequence, and (c) introducing chemical modifications (e.g. chemical modifications as described herein or as otherwise known in the art) into the active siNA molecules of (b). In one embodiment, the method further comprises re-screening the chemically modified siNA molecules of step (c) under conditions suitable for isolating chemically modified siNA molecules that are active in mediating RNA interference against the target nucleic acid sequence.

In one embodiment, the invention features a method for screening chemically modified siNA molecules that are active in mediating RNA interference against a target nucleic acid sequence comprising (a) generating a plurality of chemically modified siNA molecules (e.g. siNA molecules as described herein or as otherwise known in the art), and (b) screening the siNA molecules of step (a) under conditions suitable for isolating chemically modified siNA molecules that are active in mediating RNA interference against the target nucleic acid sequence.

The term "ligand" refers to any compound or molecule, such as a drug, peptide, hormone, or neurotransmitter, that is capable of interacting with another compound, such as a receptor, either directly or indirectly. The receptor that interacts with a ligand can be present on the surface of a cell or can alternately be an intercellular receptor. Interaction of the ligand with the receptor can result in a biochemical reaction, or can simply be a physical interaction or association.

In another embodiment, the invention features a method for generating siNA molecules of the invention with improved bioavailability comprising (a) introducing an excipient formulation to an siNA molecule, and (b) assaying the siNA molecule of step (a) under conditions suitable for isolating siNA molecules having improved bioavailability. Such excipients include polymers such as cyclodextrins, lipids, cationic lipids, polyamines, phospholipids, nanoparticles, receptors, ligands, and others.

In another embodiment, the invention features a method for generating siNA molecules of the invention with improved bioavailability comprising (a) introducing nucleotides having any of Formulae I-VII or any combination thereof into an siNA molecule, and (b) assaying the siNA molecule of step (a) under conditions suitable for isolating siNA molecules having improved bioavailability.

In another embodiment, polyethylene glycol (PEG) can be covalently attached to siNA compounds of the present invention. The attached PEG can be any molecular weight, preferably from about 2,000 to about 50,000 daltons (Da).

The present invention can be used alone or as a component of a kit having at least one of the reagents necessary to carry out the in vitro or in vivo introduction of RNA to test samples and/or subjects. For example, preferred components of the kit include an siNA molecule of the invention and a vehicle that promotes introduction of the siNA into cells of interest as described herein (e.g., using lipids and other methods of transfection known in the art, see for example Beigelman et al, U.S. Pat. No. 6,395,713). The kit can be used for target validation, such as in determining gene function and/or activity, or in drug optimization, and in drug discovery (see for example Usman et al., U.S. Ser. No. 60/402,996). Such a kit can also include instructions to allow a user of the kit to practice the invention.

The term "short interfering nucleic acid", "siNA", "short interfering RNA", "siRNA", "short interfering nucleic acid molecule", "short interfering oligonucleotide molecule", or "chemically-modified short interfering nucleic acid molecule" as used herein refers to any nucleic acid molecule capable of inhibiting or down regulating gene expression or viral replication, for example by mediating RNA interference "RNAi" or gene silencing in a sequence-specific manner; see for example Zamore et al., 2000, Cell, 101, 25-33; Bass, 2001, Nature, 411, 428-429; Elbashir et al., 2001, Nature, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237; Hutvagner and Zamore, 2002, Science, 297, 2056-60; McManus et al., 2002, RNA, 8, 842-850; Reinhart et al., 2002, Gene & Dev., 16, 1616-1626; and Reinhart & Bartel, 2002, Science, 297, 1831). Non limiting examples of siNA molecules of the invention are shown in FIGS. 4-6, and Tables II and III herein. For example the siNA can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The siNA can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 19 base pairs); the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof. Alternatively, the siNA is assembled from a single oligonucleotide, where the self-complementary sense and antisense regions of the siNA are linked by means of a nucleic acid based or non-nucleic acid-based linker(s). The siNA can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single-stranded polynucleotide having nucleotide sequence complementary to nucleotide sequence in a target nucleic acid molecule or a portion thereof (for example, where such siNA molecule does not require the presence within the siNA molecule of nucleotide sequence corresponding to the target nucleic acid sequence or a portion thereof), wherein the single-stranded polynucleotide can further comprise a terminal phosphate group, such as a 5'-phosphate (see for example Martinez et al., 2002, Cell., 110, 563-574 and Schwarz et al., 2002, Molecular Cell, 10, 537-568), or 5',3'-diphosphate. In certain embodiments, the siNA molecule of the invention comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the siNA molecules of the invention comprise nucleotide sequence that is complementary to nucleotide sequence of a target gene. In another embodiment, the siNA molecule of the invention interacts with nucleotide sequence of a target gene in a manner that causes inhibition of expression of the target gene. As used herein, siNA molecules need not be limited to those molecules containing only RNA, but further encompasses chemically-modified nucleotides and non-nucleotides. In certain embodiments, the short interfering nucleic acid molecules of the invention lack 2'-hydroxy (2'-OH) containing nucleotides. Applicant describes in certain embodiments short interfering nucleic acids that do not require the presence of nucleotides having a 2'-hydroxy group for mediating RNAi and as such, short interfering nucleic acid molecules of the invention optionally do not include any ribonucleotides (e.g., nucleotides having a 2'-OH group). Such siNA molecules that do not require the presence of ribonucleotides within the siNA molecule to support RNAi can however have an attached linker or linkers or other attached or associated groups, moieties, or chains containing one or more nucleotides with 2'-OH groups. Optionally, siNA molecules can comprise ribonucleotides at about 5, 10, 20, 30, 40, or 50% of the nucleotide positions. The modified short interfering nucleic acid molecules of the invention can also be referred to as short interfering modified oligonucleotides "siMON." As used herein, the term siNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically-modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics. For example, siNA molecules of the invention can be used to epigenetically silence genes at both the post-transcriptional level or the pre-transcriptional level. In a non-limiting example, epigenetic regulation of gene expression by siNA molecules of the invention can result from siNA mediated modification of chromatin structure or methylation pattern to alter gene expression (see, for example, Verdel et al., 2004, Science, 303, 672-676; Pal-Bhadra et al., 2004, Science, 303, 669-672; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

In one embodiment, an siNA molecule of the invention is a duplex forming oligonucleotide "DFO", (see for example FIGS. 14-15 and Vaish et al., U.S. Ser. No. 10/727,780 filed Dec. 3, 2003 and McSwiggen et al., PCT/US04/16390, filed May 24, 2004).

In one embodiment, an siNA molecule of the invention is a multifunctional siNA, (see for example FIGS. 16-22 and Jadhav et al., U.S. Ser. No. 60/543,480 filed Feb. 10, 2004 and McSwiggen et al., PCT/US04/16390, filed May 24, 2004). The multifunctional siNA of the invention can comprise sequence targeting, for example, two regions of interleukin and/or interleukin receptor RNA (see for example target sequences in Tables II and III).

By "asymmetric hairpin" as used herein is meant a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 19 to about 22, or about 19, 20, 21, or 22 nucleotides) and a loop region comprising about 4 to about 8 (e.g., about 4, 5, 6, 7, or 8) nucleotides, and a sense region having about 3 to about 18 (e.g., about 3, 4, 5, 6, 7, 8, 9, 10, 11, 12, 13, 14, 15, 16, 17, or 18) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

By "asymmetric duplex" as used herein is meant an siNA molecule having two separate strands comprising a sense region and an antisense region, wherein the sense region comprises fewer nucleotides than the antisense region to the extent that the sense region has enough complementary nucleotides to base pair with the antisense region and form a duplex. For example, an asymmetric duplex siNA molecule of the invention can comprise an antisense region having length sufficient to mediate RNAi in a cell or in vitro system e.g. about 19 to about 22 (e.g. about 19, 20, 21, or 22) nucleotides and a sense region having about 3 to about 18 (e.g., about 3, 4, 5, 6, 7, 8, 9, 10, 11, 12, 13, 14, 15, 16, 17, or 18) nucleotides that are complementary to the antisense region.

By "modulate" is meant that the expression of the gene, or level of RNA molecule or equivalent RNA molecules encoding one or more proteins or protein subunits, or activity of one or more proteins or protein subunits is up regulated or down regulated, such that expression, level, or activity is greater than or less than that observed in the absence of the modulator. For example, the term "modulate" can mean "inhibit," but the use of the word "modulate" is not limited to this definition.

By "inhibit", "down-regulate", or "reduce", it is meant that the expression of the gene, or level of RNA molecules or equivalent RNA molecules encoding one or more proteins or protein subunits, or activity of one or more proteins or protein subunits, is reduced below that observed in the absence of the nucleic acid molecules (e.g., siNA) of the invention. In one embodiment, inhibition, down-regulation or reduction with an siNA molecule is below that level observed in the presence of an inactive or attenuated molecule. In another embodiment, inhibition, down-regulation, or reduction with siNA molecules is below that level observed in the presence of, for example, an siNA molecule with scrambled sequence or with mismatches. In another embodiment, inhibition, down-regulation, or reduction of gene expression with a nucleic acid molecule of the instant invention is greater in the presence of the nucleic acid molecule than in its absence.

By "gene", or "target gene", is meant, a nucleic acid that encodes an RNA, for example, nucleic acid sequences including, but not limited to, structural genes encoding a polypeptide. A gene or target gene can also encode a functional RNA (fRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of fRNA or ncRNA involved in functional or regulatory cellular processes. Aberrant fRNA or ncRNA activity leading to disease can therefore be modulated by siNA molecules of the invention. siNA molecules targeting fRNA and ncRNA can also be used to manipulate or alter the genotype or phenotype of an organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, *Science*, 300, 258-260.

By "non-canonical base pair" is meant any non-Watson Crick base pair, such as mismatches and/or wobble base pairs, including flipped mismatches, single hydrogen bond mismatches, trans-type mismatches, triple base interactions, and quadruple base interactions. Non-limiting examples of such non-canonical base pairs include, but are not limited to, AC reverse Hoogsteen, AC wobble, AU reverse Hoogsteen, GU wobble, AA N7 amino, CC 2-carbonyl-amino(H1)-N-3-amino(H2), GA sheared, UC 4-carbonyl-amino, UU imino-carbonyl, AC reverse wobble, AU Hoogsteen, AU reverse Watson Crick, CG reverse Watson Crick, GC N3-amino-amino N3, AA N1-amino symmetric, AA N7-amino symmetric, GA N7-N1 amino-carbonyl, GA+carbonyl-amino N7-N1, GG N1-carbonyl symmetric, GG N3-amino symmetric, CC carbonyl-amino symmetric, CC N3-amino symmetric, UU 2-carbonyl-imino symmetric, UU 4-carbonyl-imino symmetric, AA amino-N3, AA N1-amino, AC amino 2-carbonyl, AC N3-amino, AC N7-amino, AU amino-4-carbonyl, AU N1-imino, AU N3-imino, AU N7-imino, CC carbonyl-amino, GA amino-N1, GA amino-N7, GA carbonyl-amino, GA N3-amino, GC amino-N3, GC carbonyl-amino, GC N3-amino, GC N7-amino, GG amino-N7, GG carbonyl-imino, GG N7-amino, GU amino-2-carbonyl, GU carbonyl-imino, GU imino-2-carbonyl, GU N7-imino, psiU imino-2-carbonyl, UC 4-carbonyl-amino, UC imino-carbonyl, UU imino-4-carbonyl, AC C2-H—N3, GA carbonyl-C2-H, UU imino-4-carbonyl 2 carbonyl-C5-H, AC amino(A) N3(C)-carbonyl, GC imino amino-carbonyl, Gpsi imino-2-carbonyl amino-2-carbonyl, and GU imino amino-2-carbonyl base pairs.

By "interleukin" is meant, any interleukin (e.g., IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, and IL-27) polypeptide, protein and/or a polynucleotide encoding an interleukin protein, peptide, or portion thereof (such as polynucleotides referred to by Genbank Accession numbers in Table I or any other interleukin transcript derived from an interleukin gene). The term "interleukin" is also meant to include other interleukin encoding sequence, such as mutant interleukin genes, splice variants of interleukin genes, and interleukin gene polymorphisms, such as those associated with a disease, trait, or condition.

By "interleukin protein" is meant, any interleukin peptide or protein or a component thereof, wherein the peptide or protein is encoded by an interleukin gene or having interleukin activity.

By "interleukin receptor" is meant, any interleukin receptor (e.g., IL-1R, IL-2R, IL-3R, IL-4R, IL-5R, IL-6R, IL-7R, IL-8R, IL-9R, IL-10R, IL-11R, IL-12R, IL-13R, IL-14R, IL-15R, IL-16R, IL-17R, IL-18R, IL-19R, IL-20R, IL-21R, IL-22R, IL-23R, IL-24R, IL-25R, IL-26R, and IL-27R) polypeptide, protein and/or a polynucleotide encoding an interleukin receptor protein, peptide, or portion thereof (such as polynucleotides referred to by Genbank Accession numbers in Table I or any other interleukin receptor transcript derived from an interleukin receptor gene). The term "interleukin receptor" is also meant to include other interleukin receptor encoding sequence, such as mutant interleukin receptor genes, splice variants of interleukin receptor genes, and interleukin receptor gene polymorphisms, such as those associated with a disease, trait, or condition.

By "interleukin receptor protein" is meant, any interleukin receptor peptide or protein or a component thereof, wherein the peptide or protein is encoded by an interleukin receptor gene or having interleukin receptor activity.

By "homologous sequence" is meant, a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes, such as a cytokine and its corresponding receptors. A homologous sequence can be a nucleotide sequence that is shared by two or more non-coding polynucleotides, such as noncoding DNA or RNA, regulatory sequences, introns, and sites of transcriptional control or regulation. Homologous sequences can also include conserved sequence regions shared by more than one polynucleotide sequence. Homology does not need to be perfect homology (e.g., 100%), as partially homologous sequences are also contemplated by the instant invention (e.g., 99%, 98%, 97%, 96%, 95%, 94%, 93%, 92%, 91%, 90%, 89%, 88%, 87%, 86%, 85%, 84%, 83%, 82%, 81%, 80% etc.).

By "conserved sequence region" is meant, a nucleotide sequence of one or more regions in a polynucleotide does not vary significantly between generations or from one biological system or organism to another biological system or organism. The polynucleotide can include both coding and non-coding DNA and RNA.

By "sense region" is meant a nucleotide sequence of an siNA molecule having complementarity to an antisense region of the siNA molecule. In addition, the sense region of an siNA molecule can comprise a nucleic acid sequence having homology with a target nucleic acid sequence.

By "antisense region" is meant a nucleotide sequence of an siNA molecule having complementarity to a target nucleic acid sequence. In addition, the antisense region of an siNA molecule can optionally comprise a nucleic acid sequence having complementarity to a sense region of the siNA molecule.

By "target nucleic acid" is meant any nucleic acid sequence whose expression or activity is to be modulated. The target nucleic acid can be DNA or RNA.

By "complementarity" is meant that a nucleic acid can form hydrogen bond(s) with another nucleic acid sequence by either traditional Watson-Crick or other non-traditional types. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol.* LII pp. 123-133; Frier et al., 1986, *Proc. Nat. Acad. Sci. USA* 83:9373-9377; Turner et al., 1987, *J. Am. Chem. Soc.* 109:3783-3785). A percent complementarity indicates the percentage of contiguous residues in a nucleic acid molecule that can form hydrogen bonds (e.g., Watson-Crick base pairing) with a second nucleic acid sequence (e.g., 5, 6, 7, 8, 9, or 10 nucleotides out of a total of 10 nucleotides in the first oligonucleotide being based paired to a second nucleic acid sequence having 10 nucleotides represents 50%, 60%, 70%, 80%, 90%, and 100% complementary respectively). "Perfectly complementary" means that all the contiguous residues of a nucleic acid sequence will hydrogen bond with the same number of contiguous residues in a second nucleic acid sequence.

In one embodiment, siNA molecules of the invention that down regulate or reduce interleukin and/or interleukin receptor gene expression are used for preventing or reducing cancers and other proliferative conditions, viral infection, inflammatory disease, autoimmunity, respiratory disease, pulmonary disease, cardiovascular disease, neurological disease, renal disease, ocular disease, liver disease, mitochondrial disease, endocrine disease, prion disease, reproduction related diseases and conditions or any other disease associated with interleukin and/or interleukin receptor gene expression in a subject. In one embodiment, the siNA molecules of the invention that down regulate or reduce interleukin and/or interleukin receptor gene expression are used for treating or preventing asthma, chronic obstructive pulmonary disease or "COPD", allergic rhinitis, sinusitis, pulmonary vasoconstriction, inflammation, allergies, impeded respiration, respiratory distress syndrome, cystic fibrosis, pulmonary hypertension, pulmonary vasoconstriction, or emphysema in a subject.

By "cancer" is meant a group of diseases characterized by uncontrolled growth and spread of abnormal cells.

By "proliferative disease" or "cancer" is meant, any disease, condition, trait, genotype or phenotype characterized by unregulated cell growth or replication as is known in the art; including AIDS related cancers such as Kaposi's sarcoma; breast cancers; bone cancers such as Osteosarcoma, Chondrosarcomas, Ewing's sarcoma, Fibrosarcomas, Giant cell tumors, Adamantinomas, and Chordomas; Brain cancers such as Meningiomas, Glioblastomas, Lower-Grade Astrocytomas, Oligodendrocytomas, Pituitary Tumors, Schwannomas, and Metastatic brain cancers; cancers of the head and neck including various lymphomas such as mantle cell lymphoma, non-Hodgkins lymphoma, adenoma, squamous cell carcinoma, laryngeal carcinoma, gallbladder and bile duct cancers, cancers of the retina such as retinoblastoma, cancers of the esophagus, gastric cancers, multiple myeloma, ovarian cancer, uterine cancer, thyroid cancer, testicular cancer, endometrial cancer, melanoma, colorectal cancer, lung cancer, bladder cancer, prostate cancer, lung cancer (including non-small cell lung carcinoma), pancreatic cancer, sarcomas, Wilms' tumor, cervical cancer, head and neck cancer, skin cancers, nasopharyngeal carcinoma, liposarcoma, epithelial carcinoma, renal cell carcinoma, gallbladder adeno carcinoma, parotid adenocarcinoma, endometrial sarcoma, multi-drug resistant cancers; and proliferative diseases and conditions, such as neovascularization associated with tumor angiogenesis, macular degeneration (e.g., wet/dry AMD), corneal neovascularization, diabetic retinopathy, neovascular glaucoma, myopic degeneration and other proliferative diseases and conditions such as restenosis and polycystic kidney disease, and any other cancer or proliferative disease, condition, trait, genotype or phenotype that can respond to the modulation of disease related gene expression in a cell or tissue, alone or in combination with other therapies.

By "inflammatory disease" or "inflammatory condition" is meant any disease, condition, trait, genotype or phenotype characterized by an inflammatory or allergic process as is known in the art, such as inflammation, acute inflammation, chronic inflammation, atherosclerosis, restenosis, asthma, allergic rhinitis, atopic dermatitis, psoriasis, septic shock, rheumatoid arthritis, inflammatory bowel disease, inflammatory pelvic disease, pain, ocular inflammatory disease, celiac disease, Leigh Syndrome, Glycerol Kinase Deficiency, Familial eosinophilia (FE), autosomal recessive spastic ataxia, laryngeal inflammatory disease; Tuberculosis, Chronic cholecystitis, Bronchiectasis, Silicosis and other pneumoconiosis, and any other inflammatory disease, condition, trait, genotype or phenotype that can respond to the modulation of disease related gene expression in a cell or tissue, alone or in combination with other therapies.

By "respiratory disease" is meant, any disease or condition affecting the respiratory tract, such as asthma, chronic obstructive pulmonary disease or "COPD", allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema, and any other respiratory disease, condition, trait, genotype or phenotype that can respond to the modulation of disease related gene expression in a cell or tissue, alone or in combination with other therapies.

By "autoimmune disease" or "autoimmune condition" is meant, any disease, condition, trait, genotype or phenotype characterized by autoimmunity as is known in the art, such as multiple sclerosis, diabetes mellitus, lupus, celiac disease, Crohn's disease, ulcerative colitis, Guillain-Barre syndrome, scleroderms, Goodpasture's syndrome, Wegener's granulomatosis, autoimmune epilepsy, Rasmussen's encephalitis, Primary biliary sclerosis, Sclerosing cholangitis, Autoimmune hepatitis, Addison's disease, Hashimoto's thyroiditis, Fibromyalgia, Menier's syndrome; transplantation rejection (e.g., prevention of allograft rejection) pernicious anemia, rheumatoid arthritis, systemic lupus erythematosus, dermatomyositis, Sjogren's syndrome, lupus erythematosus, multiple sclerosis, myasthenia gravis, Reiter's syndrome, Grave's disease, and any other autoimmune disease, condition, trait, genotype or phenotype that can respond to the modulation of disease related gene expression in a cell or tissue, alone or in combination with other therapies.

By "neurological disease" or "neurological disease" is meant any disease, disorder, or condition affecting the central or peripheral nervous system, including ADHD, AIDS—Neurological Complications, Absence of the Septum Pellucidum, Acquired Epileptiform Aphasia, Acute Disseminated Encephalomyelitis, Adrenoleukodystrophy, Agenesis of the Corpus Callosum, Agnosia, Aicardi Syndrome, Alexander Disease, Alpers' Disease, Alternating Hemiplegia, Alzheimer's Disease, Amyotrophic Lateral Sclerosis, Anencephaly, Aneurysm, Angelman Syndrome, Angiomatosis, Anoxia, Aphasia, Apraxia, Arachnoid Cysts, Arachnoiditis, Arnold-Chiari Malformation, Arteriovenous Malformation, Aspartame, Asperger Syndrome, Ataxia Telangiectasia, Ataxia, Attention Deficit-Hyperactivity Disorder, Autism, Autonomic Dysfunction, Back Pain, Barth Syndrome, Batten Disease, Behcet's Disease, Bell's Palsy, Benign Essential Blepharospasm, Benign Focal Amyotrophy, Benign Intracranial Hypertension, Bernhardt-Roth Syndrome, Binswanger's Disease, Blepharospasm, Bloch-Sulzberger Syndrome, Brachial Plexus Birth Injuries, Brachial Plexus Injuries, Bradbury-Eggleston Syndrome, Brain Aneurysm, Brain Injury, Brain and Spinal Tumors, Brown-Sequard Syndrome, Bulbospinal Muscular Atrophy, Canavan Disease, Carpal Tunnel Syndrome, Causalgia, Cavernomas, Cavernous Angioma, Cavernous Malformation, Central Cervical Cord Syndrome, Central Cord Syndrome, Central Pain Syndrome, Cephalic Disorders, Cerebellar Degeneration, Cerebellar Hypoplasia, Cerebral Aneurysm, Cerebral Arteriosclerosis, Cerebral Atrophy, Cerebral Beriberi, Cerebral Gigantism, Cerebral Hypoxia, Cerebral Palsy, Cerebro-Oculo-Facio-Skeletal Syndrome, Charcot-Marie-Tooth Disorder, Chiari Malformation, Chorea, Choreoacanthocytosis, Chronic Inflammatory Demyelinating Polyneuropathy (CIDP), Chronic Orthostatic Intolerance, Chronic Pain, Cockayne Syndrome Type II, Coffin Lowry Syndrome, Coma, including Persistent Vegetative State, Complex Regional Pain Syndrome, Congenital Facial Diplegia, Congenital Myasthenia, Congenital Myopathy, Congenital Vascular Cavernous Malformations, Corticobasal Degeneration, Cranial Arteritis, Craniosynostosis, Creutzfeldt-Jakob Disease, Cumulative Trauma Disorders, Cushing's Syndrome, Cytomegalic Inclusion Body Disease (CIBD), Cytomegalovirus Infection, Dancing Eyes-Dancing Feet Syndrome, Dandy-Walker Syndrome, Dawson Disease, De Morsier's Syndrome, Dejerine-Klumpke Palsy, Dementia—Multi-Infarct, Dementia—Subcortical, Dementia With Lewy Bodies, Dermatomyositis, Developmental Dyspraxia, Devic's Syndrome, Diabetic Neuropathy, Diffuse Sclerosis, Dravet's Syndrome, Dysautonomia, Dysgraphia, Dyslexia, Dysphagia, Dyspraxia, Dystonias, Early Infantile Epileptic Encephalopathy, Empty Sella Syndrome, Encephalitis Lethargica, Encephalitis and Meningitis, Encephaloceles, Encephalopathy, Encephalotrigeminal Angiomatosis, Epilepsy, Erb's Palsy, Erb-Duchenne and Dejerine-Klumpke Palsies, Fabry's Disease, Fahr's Syndrome, Fainting, Familial Dysautonomia, Familial Hemangioma, Familial Idiopathic Basal Ganglia Calcification, Familial Spastic Paralysis, Febrile Seizures (e.g., GEFS and GEFS plus), Fisher Syndrome, Floppy Infant Syndrome, Friedreich's Ataxia, Gaucher's Disease, Gerstmann's Syndrome, Gerstmann-Straussler-Scheinker Disease, Giant Cell Arteritis, Giant Cell Inclusion Disease, Globoid Cell Leukodystrophy, Glossopharyngeal Neuralgia, Guillain-Barre Syndrome, HTLV-1 Associated Myelopathy, Hallervorden-Spatz Disease, Head Injury, Headache, Hemicrania Continua, Hemifacial Spasm, Hemiplegia Alterans, Hereditary Neuropathies, Hereditary Spastic Paraplegia, Heredopathia Atactica Polyneuritiformis, Herpes Zoster Oticus, Herpes Zoster, Hirayama Syndrome, Holoprosencephaly, Huntington's Disease, Hydranencephaly, Hydrocephalus—Normal Pressure, Hydrocephalus, Hydromyelia, Hypercortisolism, Hypersomnia, Hypertonia, Hypotonia, Hypoxia, Immune-Mediated Encephalomyelitis, Inclusion Body Myositis, Incontinentia Pigmenti, Infantile Hypotonia, Infantile Phytanic Acid Storage Disease, Infantile Refsum Disease, Infantile Spasms, Inflammatory Myopathy, Intestinal Lipodystrophy, Intracranial Cysts, Intracranial Hypertension, Isaac's Syndrome, Joubert Syndrome, Kearns-Sayre Syndrome, Kennedy's Disease, Kinsbourne syndrome, Kleine-Levin syndrome, Klippel Feil Syndrome, Klippel-Trenaunay Syndrome (KTS), Kluver-Bucy Syndrome, Korsakoff's Amnesic Syndrome, Krabbe Disease, Kugelberg-Welander Disease, Kuru, Lambert-Eaton Myasthenic Syndrome, Landau-Kleffner Syndrome, Lateral Femoral Cutaneous Nerve Entrapment, Lateral Medullary Syndrome, Learning Disabilities, Leigh's Disease, Lennox-Gastaut Syndrome, Lesch-Nyhan Syndrome, Leukodystrophy, Levine-Critchley Syndrome, Lewy Body Dementia, Lissencephaly, Locked-In Syndrome, Lou Gehrig's Disease, Lupus—Neurological Sequelae, Lyme Disease—Neurological Complications, Machado-Joseph Disease, Macrencephaly, Megalencephaly, Melkersson-Rosenthal Syndrome, Meningitis, Menkes Disease, Meralgia Paresthetica, Metachromatic Leukodystrophy, Microcephaly, Migraine, Miller Fisher Syndrome, Mini-Strokes, Mitochondrial Myopathies, Mobius Syndrome, Monomelic Amyotrophy, Motor Neuron Diseases, Moyamoya Disease, Mucolipidoses, Mucopolysaccharidoses, Multi-Infarct Dementia, Multifocal Motor Neuropathy, Multiple Sclerosis, Multiple System Atrophy with Orthostatic Hypotension, Multiple System Atrophy, Muscular Dystrophy, Myasthenia—Congenital, Myasthenia Gravis, Myelinoclastic Diffuse Sclerosis, Myoclonic Encephalopathy of Infants, Myoclonus, Myopathy—Congenital, Myopathy—Thyrotoxic, Myopathy, Myotonia Congenita, Myotonia, Narcolepsy, Neuroacanthocytosis, Neurodegeneration with Brain Iron Accumulation, Neurofibromatosis, Neuroleptic Malignant Syndrome, Neurological Complications of AIDS, Neurological Manifestations of Pompe Disease, Neuromyelitis Optica, Neuromyotonia, Neuronal Ceroid Lipofuscinosis, Neuronal Migration Disorders, Neuropathy—Hereditary, Neurosarcoidosis, Neurotoxicity, Nevus Cavemosus, Niemann-Pick Disease, O'Sullivan-McLeod Syndrome, Occipital Neuralgia, Occult Spinal Dysraphism Sequence, Ohtahara Syndrome, Olivopontocerebellar Atrophy, Opsoclonus Myoclonus, Orthostatic Hypotension, Overuse Syndrome, Pain—Chronic, Paraneoplastic Syndromes, Paresthesia, Parkinson's Disease, Parmyotonia Congenita, Paroxysmal Choreoathetosis, Paroxysmal Hemicrania, Parry-Romberg, Pelizaeus-Merzbacher Disease, Pena Shokeir II Syndrome, Perineural Cysts, Periodic Paralyses, Peripheral Neuropathy, Periventricular Leukomalacia, Persistent Vegetative State, Pervasive Developmental Disorders, Phytanic Acid Storage Disease, Pick's Disease, Piriformis Syndrome, Pituitary Tumors, Polymyositis, Pompe Disease, Porencephaly, Post-Polio Syndrome, Postherpetic Neuralgia, Postinfectious Encephalomyelitis, Postural Hypotension, Postural Orthostatic Tachycardia Syndrome, Postural Tachycardia Syndrome, Primary Lateral Sclerosis, Prion Diseases, Progressive Hemifacial Atrophy, Progressive Locomotor Ataxia, Progressive Multifocal Leukoencephalopathy, Progressive Sclerosing Poliodystrophy, Progressive Supranuclear Palsy, Pseudotumor Cerebri, Pyridoxine Dependent and Pyridoxine Responsive Siezure Disorders, Ramsay Hunt Syndrome Type I, Ramsay Hunt Syndrome Type II, Rasmussen's Encephalitis and other autoimmune epilepsies, Reflex Sympathetic Dystrophy Syndrome, Refsum Disease—Infantile, Refsum Disease, Repetitive Motion Disorders, Repetitive Stress Injuries, Restless Legs Syndrome, Retrovirus-Associated Myelopathy, Rett Syndrome, Reye's Syndrome, Riley-Day Syndrome, SUNCT Headache, Sacral Nerve Root Cysts, Saint Vitus Dance, Salivary Gland Disease, Sandhoff Disease, Schilder's Disease, Schizencephaly, Seizure Disorders, Septo-Optic Dysplasia, Severe Myoclonic Epilepsy of Infancy (SMEI), Shaken Baby Syndrome, Shingles, Shy-Drager Syndrome, Sjogren's Syndrome, Sleep Apnea, Sleeping Sickness, Soto's Syndrome, Spasticity, Spina Bifida, Spinal Cord Infarction, Spinal Cord Injury, Spinal Cord Tumors, Spinal Muscular Atrophy, Spinocerebellar Atrophy, Steele-Richardson-Olszewski Syndrome, Stiff-Person Syndrome, Striatonigral Degeneration, Stroke, Sturge-Weber Syndrome, Subacute Sclerosing Panencephalitis, Subcortical Arteriosclerotic Encephalopathy, Swallowing Disorders, Sydenham Chorea, Syncope, Syphilitic Spinal Sclerosis, Syringohydromyelia, Syringomyelia, Systemic Lupus Erythematosus, Tabes Dorsalis, Tardive Dyskinesia, Tarlov Cysts, Tay-Sachs Disease, Temporal Arteritis, Tethered Spinal Cord Syndrome, Thomsen Disease, Thoracic Outlet Syndrome, Thyrotoxic Myopathy, Tic Douloureux, Todd's Paralysis, Tourette Syndrome, Transient Ischemic Attack, Transmissible Spongiform Encephalopathies, Transverse Myelitis, Traumatic Brain Injury, Tremor, Trigeminal Neuralgia, Tropical Spastic Paraparesis, Tuberous Sclerosis, Vascular Erectile Tumor, Vasculitis including Temporal Arteritis, Von Economo's Disease, Von Hippel-Lindau disease (VHL), Von Recklinghausen's Disease, Wallenberg's Syndrome, Werdnig-Hoffman Disease, Wernicke-Korsakoff Syndrome, West Syndrome, Whipple's Disease, Williams Syndrome, Wilson's Disease, X-Linked Spinal and Bulbar Muscular Atrophy, and Zellweger Syndrome.

By "infectious disease" is meant any disease, condition, trait, genotype or phenotype associated with an infectious agent, such as a virus, bacteria, fungus, prion, or parasite. Non-limiting examples of various viral genes that can be targeted using siNA molecules of the invention include Hepatitis C Virus (HCV, for example Genbank Accession Nos: D11168, D50483.1, L38318 and S82227), Hepatitis B Virus (HBV, for example GenBank Accession No. AF100308.1), Human Immunodeficiency Virus type 1 (HIV-1, for example GenBank Accession No. U51188), Human Immunodeficiency Virus type 2 (HIV-2, for example GenBank Accession No. X60667), West Nile Virus (WNV for example GenBank accession No. NC_001563), cytomegalovirus (CMV for example GenBank Accession No. NC_001347), respiratory syncytial virus (RSV for example GenBank Accession No. NC_001781), influenza virus (for example GenBank Accession No. AF037412, rhinovirus (for example, GenBank accession numbers: D00239, X02316, X01087, L24917, M16248, K02121, X01087), papillomavirus (for example GenBank Accession No. NC_001353), Herpes Simplex Virus (HSV for example GenBank Accession No. NC_001345), and other viruses such as HTLV (for example GenBank Accession No. AJ430-458). Due to the high sequence variability of many viral genomes, selection of siNA molecules for broad therapeutic applications would likely involve the conserved regions of the viral genome. Nonlimiting examples of conserved regions of the viral genomes include but are not limited to 5'-Non Coding Regions (NCR), 3'-Non Coding Regions (NCR) and/or internal ribosome entry sites (IRES). siNA molecules designed against conserved regions of various viral genomes will enable efficient inhibition of viral replication in diverse patient populations and may ensure the effectiveness of the siNA molecules against viral quasi species which evolve due to mutations in the non-conserved regions of the viral genome. Non-limiting examples of bacterial infections include Actinomycosis, Anthrax, Aspergillosis, Bacteremia, Bacterial Infections and Mycoses, *Bartonella* Infections, Botulism, Brucellosis, *Burkholderia* Infections, *Campylobacter* Infections, Candidiasis, Cat-Scratch Disease, *Chlamydia* Infections, Cholera, *Clostridium* Infections, Coccidioidomycosis, Cross Infection, Cryptococcosis, Dermatomycoses, Dermatomycoses, Diphtheria, Ehrlichiosis, *Escherichia coli* Infections, Fasciitis, Necrotizing, *Fusobacterium* Infections, Gas Gangrene, Gram-Negative Bacterial Infections, Gram-Positive Bacterial Infections, Histoplasmosis, Impetigo, *Klebsiella* Infections, Legionellosis, Leprosy, Leptospirosis, *Listeria* Infections, Lyme Disease, *Maduromycosis, Melioidosis, Mycobacterium* Infections, *Mycoplasma* Infections, Mycoses, *Nocardia* Infections, Onychomycosis, Ornithosis, Plague, Pneumococcal Infections, *Pseudomonas* Infections, Q Fever, Rat-Bite Fever, Relapsing Fever, Rheumatic Fever, *Rickettsia* Infections, Rocky Mountain Spotted Fever, *Salmonella* Infections, Scarlet Fever, Scrub Typhus, Sepsis, Sexually Transmitted Diseases—Bacterial, Bacterial Skin Diseases, Staphylococcal Infections, Streptococcal Infections, Tetanus, Tick-Borne Diseases, Tuberculosis, Tularemia, Typhoid Fever, Typhus, Epidemic Louse-Borne, *Vibrio* Infections, Yaws, *Yersinia* Infections, Zoonoses, and Zygomycosis. Non-limiting examples of fungal infections include Aspergillosis, Blastomycosis, Coccidioidomycosis, Cryptococcosis, Fungal Infections of Fingernails and Toenails, Fungal Sinusitis, Histoplasmosis, Histoplasmosis, Mucormycosis, Nail Fungal Infection, Paracoccidioidomycosis, Sporotrichosis, Valley Fever (Coccidioidomycosis), and Mold Allergy.

By "ocular disease" is meant, any disease, condition, trait, genotype or phenotype of the eye and related structures, such as Cystoid Macular Edema, Asteroid Hyalosis, Pathological Myopia and Posterior Staphyloma, Toxocariasis (Ocular Larva Migrans), Retinal Vein Occlusion, Posterior Vitreous Detachment, Tractional Retinal Tears, Epiretinal Membrane, Diabetic Retinopathy, Lattice Degeneration, Retinal Vein Occlusion, Retinal Artery Occlusion, Macular Degeneration (e.g., age related macular degeneration such as wet AMD or dry AMD), Toxoplasmosis, Choroidal Melanoma, Acquired Retinoschisis, Hollenhorst Plaque, Idiopathic Central Serous Chorioretinopathy, Macular Hole, Presumed Ocular Histoplasmosis Syndrome, Retinal Macroaneursym, Retinitis Pigmentosa, Retinal Detachment, Hypertensive Retinopathy, Retinal Pigment Epithelium (RPE) Detachment, Papillophlebitis, Ocular Ischemic Syndrome, Coats' Disease, Leber's Miliary Aneurysm, Conjunctival Neoplasms, Allergic Conjunctivitis, Vernal Conjunctivitis, Acute Bacterial Conjunctivitis, Allergic Conjunctivitis & Vernal Keratoconjunctivitis, Viral Conjunctivitis, Bacterial Conjunctivitis, Chlamydial & Gonococcal Conjunctivitis, Conjunctival Laceration, Episcleritis, Scleritis, Pingueculitis, Pterygium, Superior Limbic Keratoconjunctivitis (SLK of Theodore), Toxic Conjunctivitis, Conjunctivitis with Pseudomembrane, Giant Papillary Conjunctivitis, Terrien's Marginal Degeneration, Acanthamoeba Keratitis, Fungal Keratitis, Filamentary Keratitis, Bacterial Keratitis, Keratitis Sicca/Dry Eye Syndrome, Bacterial Keratitis, Herpes Simplex Keratitis, Sterile Corneal Infiltrates, Phlyctenulosis, Corneal Abrasion & Recurrent Corneal Erosion, Corneal Foreign Body, Chemical Burs, Epithelial Basement Membrane Dystrophy (EBMD), Thygeson's Superficial Punctate Keratopathy, Corneal Laceration, Salzmann's Nodular Degeneration, Fuchs' Endothelial Dystrophy, Crystalline Lens Subluxation, Ciliary-Block Glaucoma, Primary Open-Angle Glaucoma, Pigment Dispersion Syndrome and Pigmentary Glaucoma, Pseudoexfoliation Syndrom and Pseudoexfoliative Glaucoma, Anterior Uveitis, Primary Open Angle Glaucoma, Uveitic Glaucoma & Glaucomatocyclitic Crisis, Pigment Dispersion Syndrome & Pigmentary Glaucoma, Acute Angle Closure Glaucoma, Anterior Uveitis, Hyphema, Angle Recession Glaucoma, Lens Induced Glaucoma, Pseudoexfoliation Syndrome and Pseudoexfoliative Glaucoma, Axenfeld-Rieger Syndrome, Neovascular Glaucoma, Pars Planitis, Choroidal Rupture, Duane's Retraction Syndrome, Toxic/Nutritional Optic Neuropathy, Aberrant Regeneration of Cranial Nerve III, Intracranial Mass Lesions, Carotid-Cavernous Sinus Fistula, Anterior Ischemic Optic Neuropathy, Optic Disc Edema & Papilledema, Cranial Nerve III Palsy, Cranial Nerve IV Palsy, Cranial Nerve VI Palsy, Cranial Nerve VII (Facial Nerve) Palsy, Horner's Syndrome, Internuclear Opthalmoplegia, Optic Nerve Head Hypoplasia, Optic Pit, Tonic Pupil, Optic Nerve Head Drusen, Demyelinating Optic Neuropathy (Optic Neuritis, Retrobulbar Optic Neuritis), Amaurosis Fugax and Transient Ischemic Attack, Pseudotumor Cerebri, Pituitary Adenoma, Molluscum Contagiosum, Canaliculitis, Verruca and Papilloma, Pediculosis and Pthiriasis, Blepharitis, Hordeolum, Preseptal Cellulitis, Chalazion, Basal Cell Carcinoma, Herpes Zoster Ophthalmicus, Pediculosis & Phthiriasis, Blow-out Fracture, Chronic Epiphora, Dacryocystitis, Herpes Simplex Blepharitis, Orbital Cellulitis, Senile Entropion, and Squamous Cell Carcinoma.

By "cardiovascular disease" is meant and disease or condition affecting the heart and vasculature, including but not limited to, coronary heart disease (CHD), cerebrovascular disease (CVD), aortic stenosis, peripheral vascular disease, atherosclerosis, arteriosclerosis, myocardial infarction (heart attack), cerebrovascular diseases (stroke), transient ischaemic attacks (TIA), angina (stable and unstable), atrial fibrillation, arrhythmia, valvular disease, and/or congestive heart failure.

In one embodiment of the present invention, each sequence of an siNA molecule of the invention is independently about 18 to about 24 nucleotides in length, in specific embodiments about 18, 19, 20, 21, 22, 23, or 24 nucleotides in length. In another embodiment, the siNA duplexes of the invention independently comprise about 17 to about 23 base pairs (e.g., about 17, 18, 19, 20, 21, 22, or 23). In yet another embodiment, siNA molecules of the invention comprising hairpin or circular structures are about 35 to about 55 (e.g., about 35, 40, 45, 50 or 55) nucleotides in length, or about 38 to about 44 (e.g., about 38, 39, 40, 41, 42, 43, or 44) nucleotides in length and comprising about 16 to about 22 (e.g., about 16, 17, 18, 19, 20, 21 or 22) base pairs. Exemplary siNA molecules of the invention are shown in Table II. Exemplary synthetic siNA molecules of the invention are shown in Table III and/or FIGS. 4-5.

As used herein "cell" is used in its usual biological sense, and does not refer to an entire multicellular organism, e.g., specifically does not refer to a human. The cell can be present in an organism, e.g., birds, plants and mammals such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The siNA molecules of the invention are added directly, or can be complexed with cationic lipids, packaged within liposomes, or otherwise delivered to target cells or tissues. The nucleic acid or nucleic acid complexes can be locally administered to relevant tissues ex vivo, or in vivo through direct dermal application, transdermal application, or injection, with or without their incorporation in biopolymers. In particular embodiments, the nucleic acid molecules of the invention comprise sequences shown in Tables II-III and/or FIGS. 4-5. Examples of such nucleic acid molecules consist essentially of sequences defined in these tables and figures. Furthermore, the chemically modified constructs described in Table IV can be applied to any siNA sequence of the invention.

In another aspect, the invention provides mammalian cells containing one or more siNA molecules of this invention. The one or more siNA molecules can independently be targeted to the same or different sites.

By "RNA" is meant a molecule comprising at least one ribonucleotide residue. By "ribonucleotide" is meant a nucleotide with a hydroxyl group at the 2' position of a β-D-ribofuranose moiety. The terms include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

By "subject" is meant an organism, which is a donor or recipient of explanted cells or the cells themselves. "Subject" also refers to an organism to which the nucleic acid molecules of the invention can be administered. A subject can be a mammal or mammalian cells, including a human or human cells.

The term "phosphorothioate" as used herein refers to an internucleotide linkage having Formula I, wherein Z and/or W comprise a sulfur atom. Hence, the term phosphorothioate refers to both phosphorothioate and phosphorodithioate internucleotide linkages.

The term "phosphonoacetate" as used herein refers to an internucleotide linkage having Formula I, wherein Z and/or W comprise an acetyl or protected acetyl group.

The term "thiophosphonoacetate" as used herein refers to an internucleotide linkage having Formula I, wherein Z comprises an acetyl or protected acetyl group and W comprises a sulfur atom or alternately W comprises an acetyl or protected acetyl group and Z comprises a sulfur atom.

The term "universal base" as used herein refers to nucleotide base analogs that form base pairs with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example Loakes, 2001, *Nucleic Acids Research*, 29, 2437-2447).

The term "acyclic nucleotide" as used herein refers to any nucleotide having an acyclic ribose sugar.

The nucleic acid molecules of the instant invention, individually, or in combination or in conjunction with other drugs, can be used to for preventing or treating cancers and other proliferative conditions, viral infection, inflammatory disease, autoimmunity, respiratory disease, pulmonary disease, cardiovascular disease, neurological disease, renal disease, ocular disease, liver disease, mitochondrial disease, endocrine disease, prion disease, or reproduction related diseases and conditions in a subject or organism. In one embodiment, siNA molecules of the invention are used in combination with anti-inflammatory agents or bronchodilators as are known in the art to treat or prevent inflammatory and respiratory diseases and/or conditions in a subject or organism.

For example, the siNA molecules can be administered to a subject or can be administered to other appropriate cells evident to those skilled in the art, individually or in combination with one or more drugs (e.g., statins, hypertensive agents etc.) under conditions suitable for the treatment.

In one embodiment, the invention features an expression vector comprising a nucleic acid sequence encoding at least one siNA molecule of the invention, in a manner which allows expression of the siNA molecule. For example, the vector can contain sequence(s) encoding both strands of an siNA molecule comprising a duplex. The vector can also contain sequence(s) encoding a single nucleic acid molecule that is self-complementary and thus forms an siNA molecule. Non-limiting examples of such expression vectors are described in Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, *Nature Medicine*, advance online publication doi: 10.1038/nm725.

In another embodiment, the invention features a mammalian cell, for example, a human cell, including an expression vector of the invention.

In yet another embodiment, the expression vector of the invention comprises a sequence for an siNA molecule having complementarity to a RNA molecule referred to by a Genbank Accession numbers, for example Genbank Accession Nos. shown in Table I.

In one embodiment, an expression vector of the invention comprises a nucleic acid sequence encoding two or more siNA molecules, which can be the same or different.

In another aspect of the invention, siNA molecules that interact with target RNA molecules and down-regulate gene encoding target RNA molecules (for example target RNA molecules referred to by Genbank Accession numbers herein) are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules. Such vectors can be repeatedly administered as necessary. Once expressed, the siNA molecules bind and down-regulate gene function or expression via RNA interference (RNAi). Delivery of siNA expressing vectors can be systemic, such as by intravenous or intramuscular administration, by administration to target cells ex-planted from a subject followed by reintroduction into the subject, or by any other means that would allow for introduction into the desired target cell.

By "vectors" is meant any nucleic acid- and/or viral-based technique used to deliver a desired nucleic acid.

Other features and advantages of the invention will be apparent from the following description of the preferred embodiments thereof, and from the claims.

BRIEF DESCRIPTION OF THE DRAWINGS

FIG. 1 shows a non-limiting example of a scheme for the synthesis of siNA molecules. The complementary siNA sequence strands, strand 1 and strand 2, are synthesized in tandem and are connected by a cleavable linkage, such as a nucleotide succinate or abasic succinate, which can be the same or different from the cleavable linker used for solid phase synthesis on a solid support. The synthesis can be either solid phase or solution phase, in the example shown, the synthesis is a solid phase synthesis. The synthesis is performed such that a protecting group, such as a dimethoxytrityl group, remains intact on the terminal nucleotide of the tandem oligonucleotide. Upon cleavage and deprotection of the oligonucleotide, the two siNA strands spontaneously hybridize to form an siNA duplex, which allows the purification of the duplex by utilizing the properties of the terminal protecting group, for example by applying a trityl on purification method wherein only duplexes/oligonucleotides with the terminal protecting group are isolated.

FIG. 4A: The sense strand comprises 21 nucleotides wherein the two terminal 3'-nucleotides are optionally base paired and wherein all nucleotides present are ribonucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety wherein the two terminal 3'-nucleotides are optionally complementary to the target RNA sequence, and wherein all nucleotides present are ribonucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4B: The sense strand comprises 21 nucleotides wherein the two terminal 3'-nucleotides are optionally base paired and wherein all pyrimidine nucleotides that may be present are 2'deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the sense and antisense strand.

FIG. 4C: The sense strand comprises 21 nucleotides having 5'- and 3'-terminal cap moieties wherein the two terminal 3'-nucleotides are optionally base paired and wherein all pyrimidine nucleotides that may be present are 2'-O-methyl or 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4D: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4E: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein. The antisense strand comprises 21 nucleotides, optionally having a 3'-terminal glyceryl moiety and wherein the two terminal 3'-nucleotides are optionally complementary to the target RNA sequence, and wherein all pyrimidine nucleotides that may be present are 2'-deoxy-2'-fluoro modified nucleotides and all purine nucleotides that may be present are 2'-O-methyl modified nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 4F: The sense strand comprises 21 nucleotides having 5'- and 3'-terminal cap moieties wherein the two terminal 3'-nucleotides are optionally base paired and wherein all pyrimidine nucleotides that may be present are 2'-deoxy-2'-fluoro modified nucleotides except for (N N) nucleotides, which can comprise ribonucleotides, deoxynucleotides, universal bases, or other chemical modifications described herein and wherein and all purine nucleotides that may be present are 2'-deoxy nucleotides. The antisense strand comprises 21 nucleotides, optionally having a 3'-terminal glyceryl moiety and wherein the two terminal 3'-nucleotides are optionally complementary to the target RNA sequence, and having one 3'-terminal phosphorothioate internucleotide linkage and wherein all pyrimidine nucleotides that may be present are 2'-deoxy-2'-fluoro modified nucleotides and all purine nucleotides that may be present are 2'-deoxy nucleotides except for (N N) nucleotides, which can comprise ribonucleotides, deoxynucleotides, universal bases, or other chemical modifications described herein. A modified internucleotide linkage, such as a phosphorothioate, phosphorodithioate or other modified internucleotide linkage as described herein, shown as "s", optionally connects the (N N) nucleotides in the antisense strand.

FIG. 7A: A DNA oligomer is synthesized with a 5'-restriction site (R1) sequence followed by a region having sequence identical (sense region of siNA) to a predetermined interleukin and/or interleukin receptor target sequence, wherein the sense region comprises, for example, about 19, 20, 21, or 22 nucleotides (N) in length, which is followed by a loop sequence of defined sequence (X), comprising, for example, about 3 to about 10 nucleotides.

FIG. 7B: The synthetic construct is then extended by DNA polymerase to generate a hairpin structure having self-complementary sequence that will result in an siNA transcript having specificity for a interleukin and/or interleukin receptor target sequence and having self-complementary sense and antisense regions.

FIG. 7C: The construct is heated (for example to about 95° C.) to linearize the sequence, thus allowing extension of a complementary second DNA strand using a primer to the 3'-restriction sequence of the first strand. The double-stranded DNA is then inserted into an appropriate vector for expression in cells. The construct can be designed such that a 3'-terminal nucleotide overhang results from the transcription, for example by engineering restriction sites and/or utilizing a poly-U termination region as described in Paul et al., 2002, Nature Biotechnology, 29, 505-508.

FIG. 8A: A DNA oligomer is synthesized with a 5'-restriction (R1) site sequence followed by a region having sequence identical (sense region of siNA) to a predetermined interleukin and/or interleukin receptor target sequence, wherein the sense region comprises, for example, about 19, 20, 21, or 22 nucleotides (N) in length, and which is followed by a 3'-restriction site (R2) which is adjacent to a loop sequence of defined sequence (X).

FIG. 8B: The synthetic construct is then extended by DNA polymerase to generate a hairpin structure having self-complementary sequence.

FIG. 8C: The construct is processed by restriction enzymes specific to R1 and R2 to generate a double-stranded DNA which is then inserted into an appropriate vector for expression in cells. The transcription cassette is designed such that a U6 promoter region flanks each side of the dsDNA which generates the separate sense and antisense strands of the siNA. Poly T termination sequences can be added to the constructs to generate U overhangs in the resulting transcript.

FIG. 9A: A pool of siNA oligonucleotides are synthesized wherein the antisense region of the siNA constructs has complementarity to target sites across the target nucleic acid sequence, and wherein the sense region comprises sequence complementary to the antisense region of the siNA.

FIGS. 9B&C: (FIG. 9B) The sequences are pooled and are inserted into vectors such that (FIG. 9C) transfection of a vector into cells results in the expression of the siNA.

FIG. 9D: Cells are sorted based on phenotypic change that is associated with modulation of the target nucleic acid sequence.

FIG. 9E: The siNA is isolated from the sorted cells and is sequenced to identify efficacious target sites within the target nucleic acid sequence.

Figure 2:
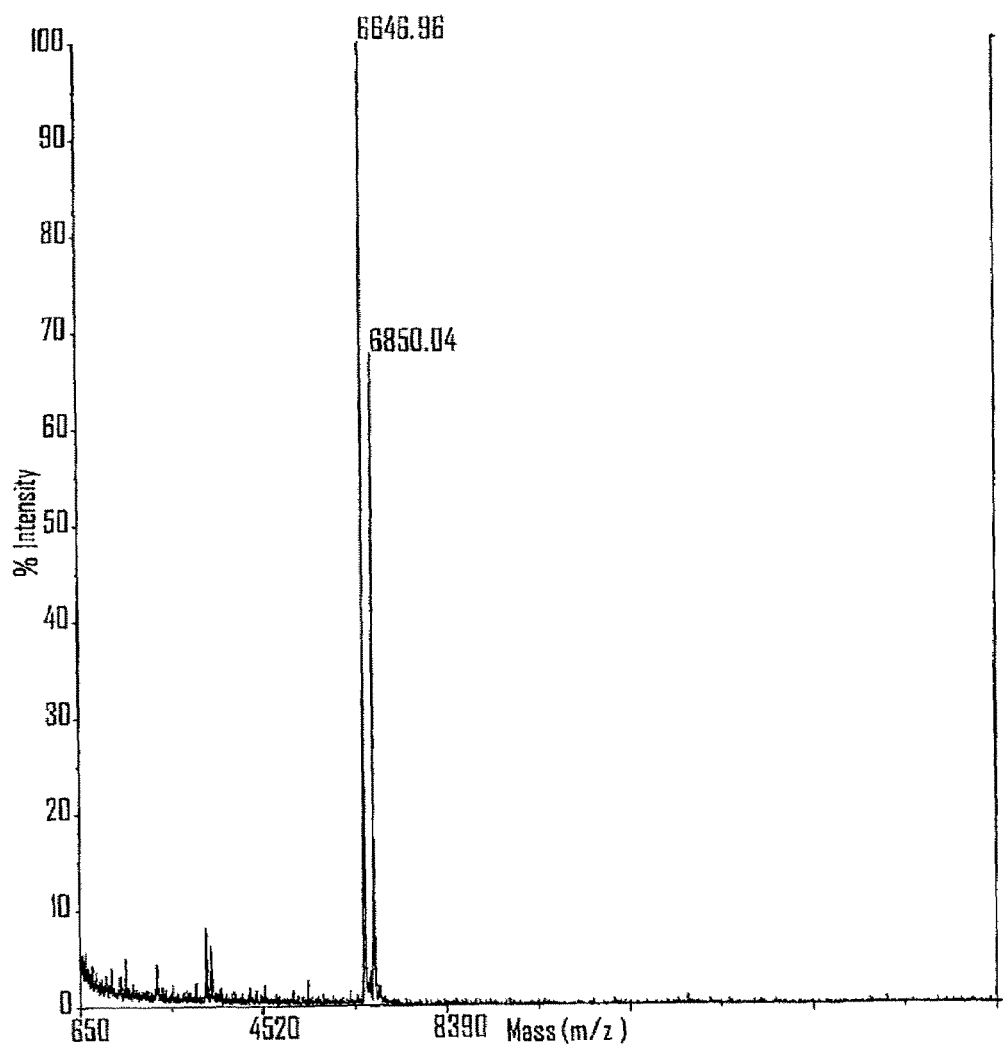
FIG. 2 shows a MALDI-TOF mass spectrum of a purified siNA duplex synthesized by a method of the invention. The two peaks shown correspond to the predicted mass of the separate siNA sequence strands. This result demonstrates that the siNA duplex generated from tandem synthesis can be purified as a single entity using a simple trityl-on purification methodology.
Figure 3:
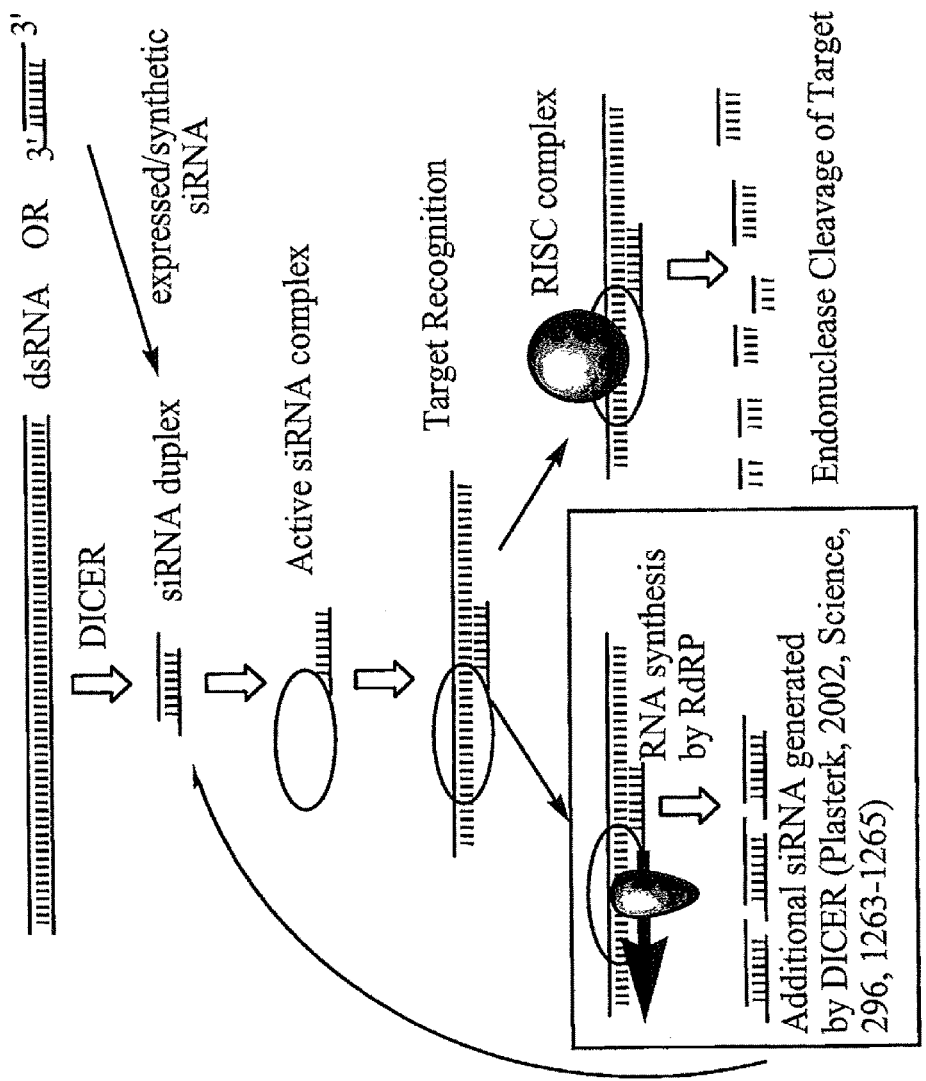
FIG. 3 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms which recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.
Figure 4:
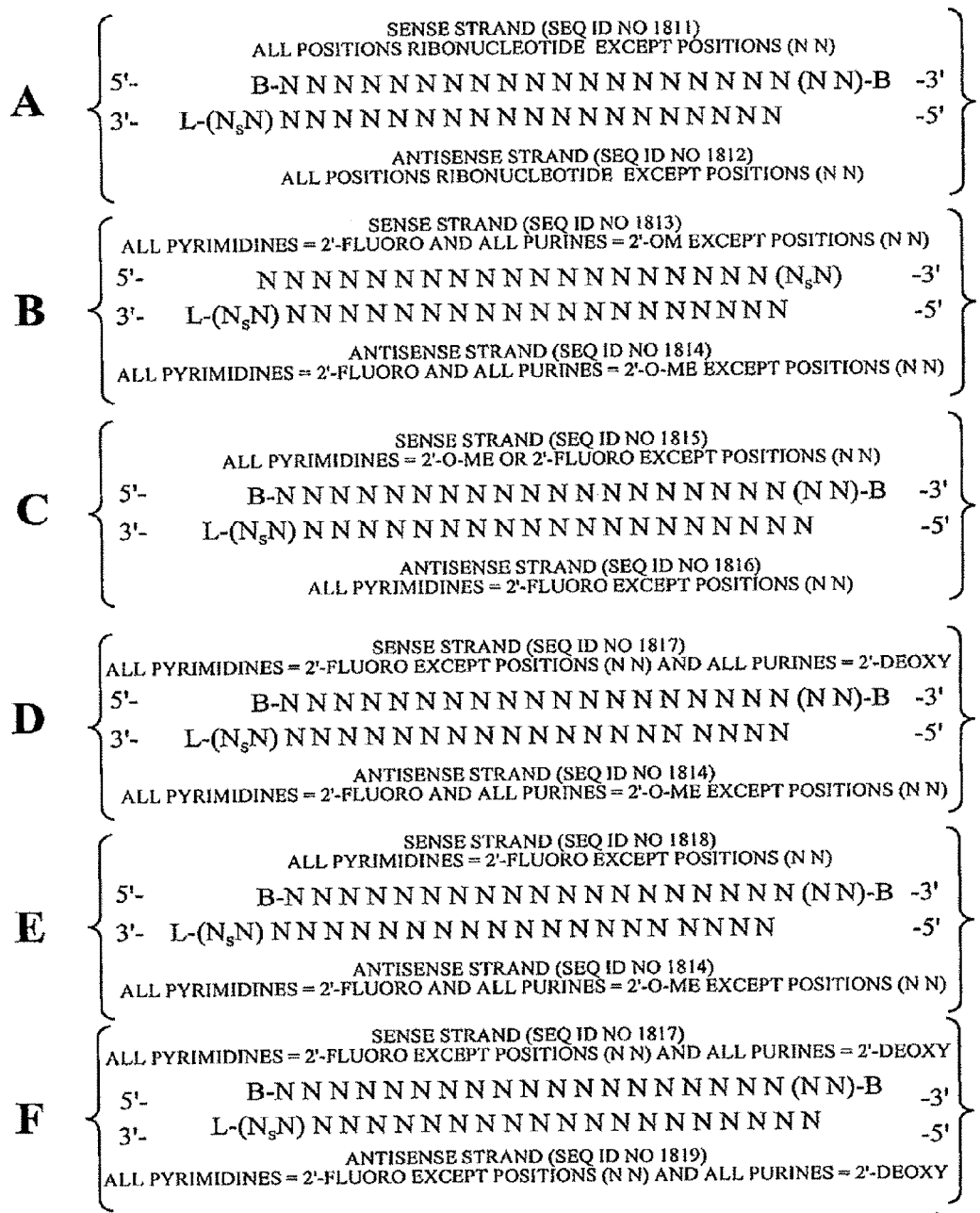
FIG. 4A-F shows non-limiting examples of chemically-modified siNA constructs of the present invention. In the figure, N stands for any nucleotide (adenosine, guanosine, cytosine, uridine, or optionally thymidine, for example thymidine can be substituted in the overhanging regions designated by parenthesis (N N). Various modifications are shown for the sense and antisense strands of the siNA constructs. The antisense strand of constructs A-F comprise sequence complementary to any target nucleic acid sequence of the invention. Furthermore, when a glyceryl moiety (L) is present at the 3'-end of the antisense strand for any construct shown in FIG. 4 A-F, the modified internucleotide linkage is optional.
Figure 5:
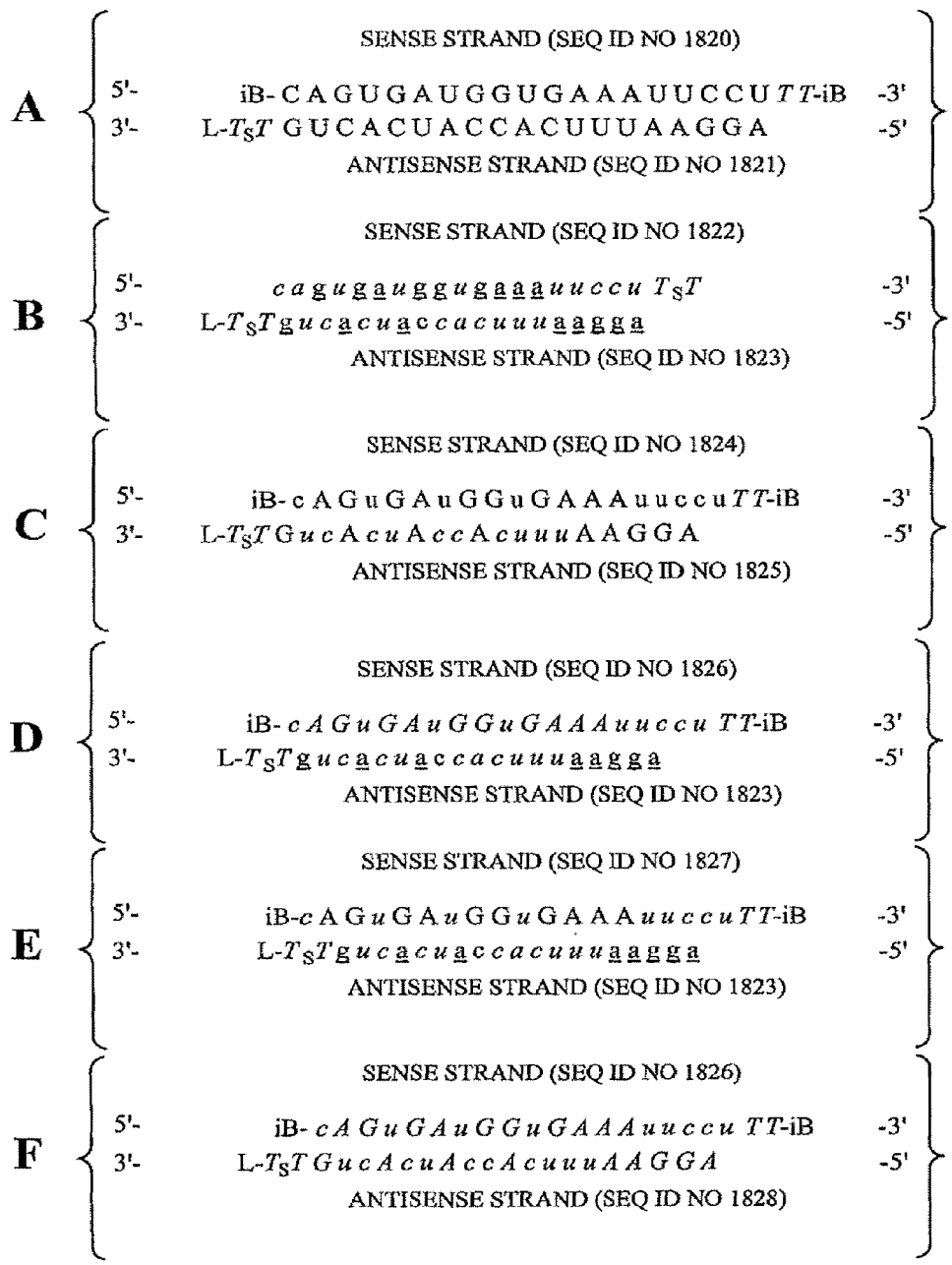
FIG. 5A-F shows non-limiting examples of specific chemically-modified siNA sequences of the invention. A-F applies the chemical modifications described in FIG. 4A-F to an IL-4R siNA sequence. Such chemical modifications can be applied to any interleukin and/or interleukin receptor sequence and/or interleukin and/or interleukin receptor polymorphism sequence.
Figure 6:
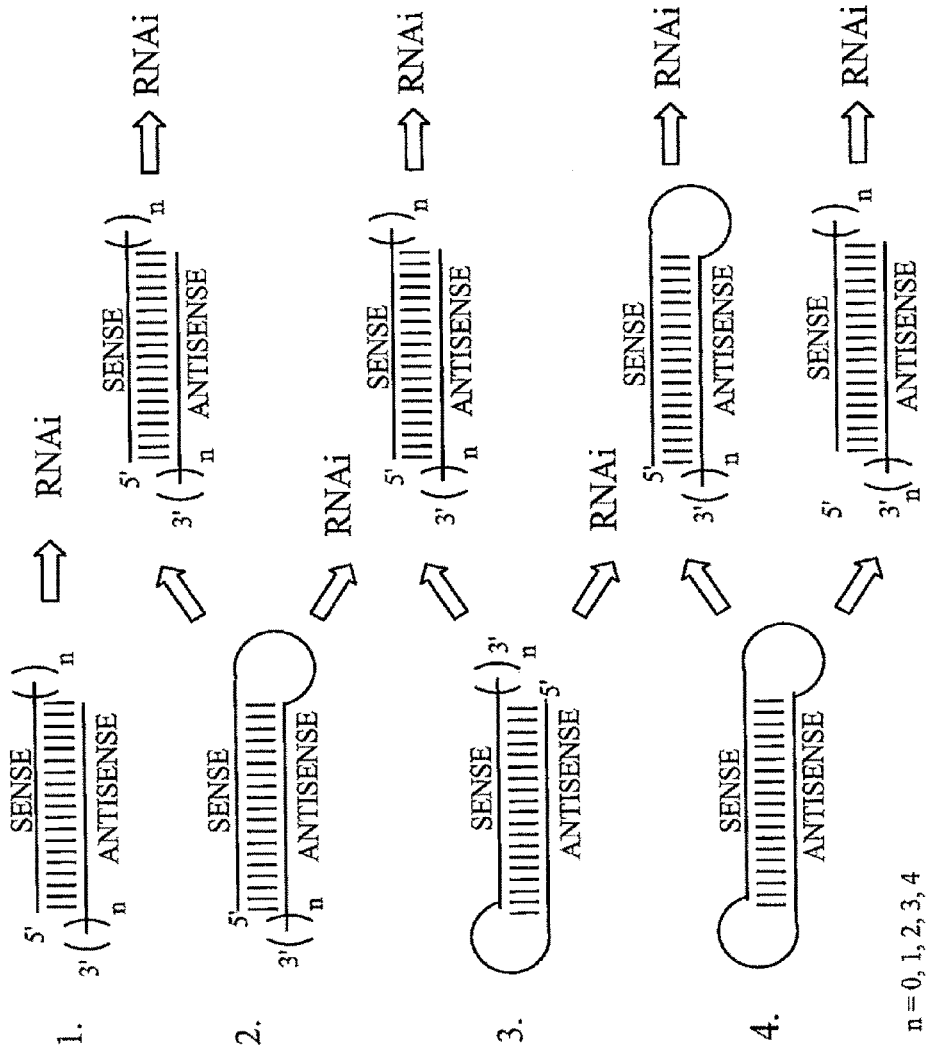
FIG. 6 shows non-limiting examples of different siNA constructs of the invention. The examples shown (constructs 1, 2, and 3) have 19 representative base pairs; however, different embodiments of the invention include any number of base pairs described herein. Bracketed regions represent nucleotide overhangs, for example comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

(10) [5-3']-dideoxyribonucleotide. In addition to modified and unmodified backbone chemistries indicated in the figure, these chemistries can be combined with different backbone modifications as described herein, for example, backbone modifications having Formula I. In addition, the 2'-deoxy nucleotide shown 5' to the terminal modifications shown can be another modified or unmodified nucleotide or non-nucleotide described herein, for example modifications having any of Formulae I-VII or any combination thereof.

FIG. 11 shows a non-limiting example of a strategy used to identify chemically modified siNA constructs of the invention that are nuclease resistance while preserving the ability to mediate RNAi activity. Chemical modifications are introduced into the siNA construct based on educated design parameters (e.g. introducing 2'-modifications, base modifications, backbone modifications, terminal cap modifications etc). The modified construct in tested in an appropriate system (e.g. human serum for nuclease resistance, shown, or an animal model for PK/delivery parameters). In parallel, the siNA construct is tested for RNAi activity, for example in a cell culture system such as a luciferase reporter assay). Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

FIG. 12 shows non-limiting examples of phosphorylated siNA molecules of the invention, including linear and duplex constructs and asymmetric derivatives thereof.

FIG. 13 shows non-limiting examples of chemically modified terminal phosphate groups of the invention.

FIG. 14A shows a non-limiting example of methodology used to design self complementary DFO constructs utilizing palindrome and/or repeat nucleic acid sequences that are identified in a target nucleic acid sequence. (i) A palindrome or repeat sequence is identified in a nucleic acid target sequence. (ii) A sequence is designed that is complementary to the target nucleic acid sequence and the palindrome sequence. (iii) An inverse repeat sequence of the non-palindrome/repeat portion of the complementary sequence is appended to the 3'-end of the complementary sequence to generate a self complementary DFO molecule comprising sequence complementary to the nucleic acid target. (iv) The DFO molecule can self-assemble to form a double-stranded oligonucleotide. FIG. 14B shows a non-limiting representative example of a duplex forming oligonucleotide sequence. FIG. 14C shows a non-limiting example of the self assembly schematic of a representative duplex forming oligonucleotide sequence. FIG. 14D shows a non-limiting example of the self assembly schematic of a representative duplex forming oligonucleotide sequence followed by interaction with a target nucleic acid sequence resulting in modulation of gene expression.

FIG. 15 shows a non-limiting example of the design of self complementary DFO constructs utilizing palindrome and/or repeat nucleic acid sequences that are incorporated into the DFO constructs that have sequence complementary to any target nucleic acid sequence of interest. Incorporation of these palindrome/repeat sequences allow the design of DFO constructs that form duplexes in which each strand is capable of mediating modulation of target gene expression, for example by RNAi. First, the target sequence is identified. A complementary sequence is then generated in which nucleotide or non-nucleotide modifications (shown as X or Y) are introduced into the complementary sequence that generate an artificial palindrome (shown as XYXYXY in the Figure). An inverse repeat of the non-palindrome/repeat complementary sequence is appended to the 3'-end of the complementary sequence to generate a self complementary DFO comprising sequence complementary to the nucleic acid target. The DFO can self-assemble to form a double-stranded oligonucleotide.

FIG. 16 shows non-limiting examples of multifunctional siNA molecules of the invention comprising two separate polynucleotide sequences that are each capable of mediating RNAi directed cleavage of differing target nucleic acid sequences. FIG. 16A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 16B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences.

FIG. 17 shows non-limiting examples of multifunctional siNA molecules of the invention comprising a single polynucleotide sequence comprising distinct regions that are each capable of mediating RNAi directed cleavage of differing target nucleic acid sequences. FIG. 17A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. FIG. 17B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 16.

FIG. 18 shows non-limiting examples of multifunctional siNA molecules of the invention comprising two separate polynucleotide sequences that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 18A shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 3'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 18B shows a non-limiting example of a multifunctional siNA molecule having a first region that is complementary to a first target nucleic acid sequence (complementary region 1) and a second region that is complementary to a second target nucleic acid sequence (complementary region 2), wherein the first and second complementary regions are situated at the 5'-ends of each polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences.

FIG. 19 shows non-limiting examples of multifunctional siNA molecules of the invention comprising a single polynucleotide sequence comprising distinct regions that are each capable of mediating RNAi directed cleavage of differing target nucleic acid sequences and wherein the multifunctional siNA construct further comprises a self complementary, palindrome, or repeat region, thus enabling shorter bifunctional siNA constructs that can mediate RNA interference against differing target nucleic acid sequences. FIG. 19A shows a non-limiting example of a multifunctional siNA molecule having a first region that is complementary to a first target nucleic acid sequence (complementary region 1) and a second region that is complementary to a second target nucleic acid sequence (complementary region 2), wherein the second complementary region is situated at the 3'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. FIG. 19B shows a non-limiting example of a multifunctional siNA molecule having a first region that is complementary to a first target nucleic acid sequence (complementary region 1) and a second region that is complementary to a second target nucleic acid sequence (complementary region 2), wherein the first complementary region is situated at the 5'-end of the polynucleotide sequence in the multifunctional siNA, and wherein the first and second complementary regions further comprise a self complementary, palindrome, or repeat region. The dashed portions of each polynucleotide sequence of the multifunctional siNA construct have complementarity with regard to corresponding portions of the siNA duplex, but do not have complementarity to the target nucleic acid sequences. In one embodiment, these multifunctional siNA constructs are processed in vivo or in vitro to generate multifunctional siNA constructs as shown in FIG. 18.

FIG. 20 shows a non-limiting example of how multifunctional siNA molecules of the invention can target two separate target nucleic acid molecules, such as separate RNA molecules encoding differing proteins, for example a cytokine and its corresponding receptor, differing viral strains, a virus and a cellular protein involved in viral infection or replication, or differing proteins involved in a common or divergent biologic pathway that is implicated in the maintenance of progression of disease. Each strand of the multifunctional siNA construct comprises a region having complementarity to separate target nucleic acid molecules. The multifunctional siNA molecule is designed such that each strand of the siNA can be utilized by the RISC complex to initiate RNA interference mediated cleavage of its corresponding target. These design parameters can include destabilization of each end of the siNA construct (see for example Schwarz et al., 2003, *Cell*, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

FIG. 21 shows a non-limiting example of how multifunctional siNA molecules of the invention can target two separate target nucleic acid sequences within the same target nucleic acid molecule, such as alternate coding regions of a RNA, coding and non-coding regions of a RNA, or alternate splice variant regions of a RNA. Each strand of the multifunctional siNA construct comprises a region having complementarity to the separate regions of the target nucleic acid molecule. The multifunctional siNA molecule is designed such that each strand of the siNA can be utilized by the RISC complex to initiate RNA interference mediated cleavage of its corresponding target region. These design parameters can include destabilization of each end of the siNA construct (see for example Schwarz et al., 2003, *Cell*, 115, 199-208). Such destabilization can be accomplished for example by using guanosine-cytidine base pairs, alternate base pairs (e.g., wobbles), or destabilizing chemically modified nucleotides at terminal nucleotide positions as is known in the art.

Figure 22:
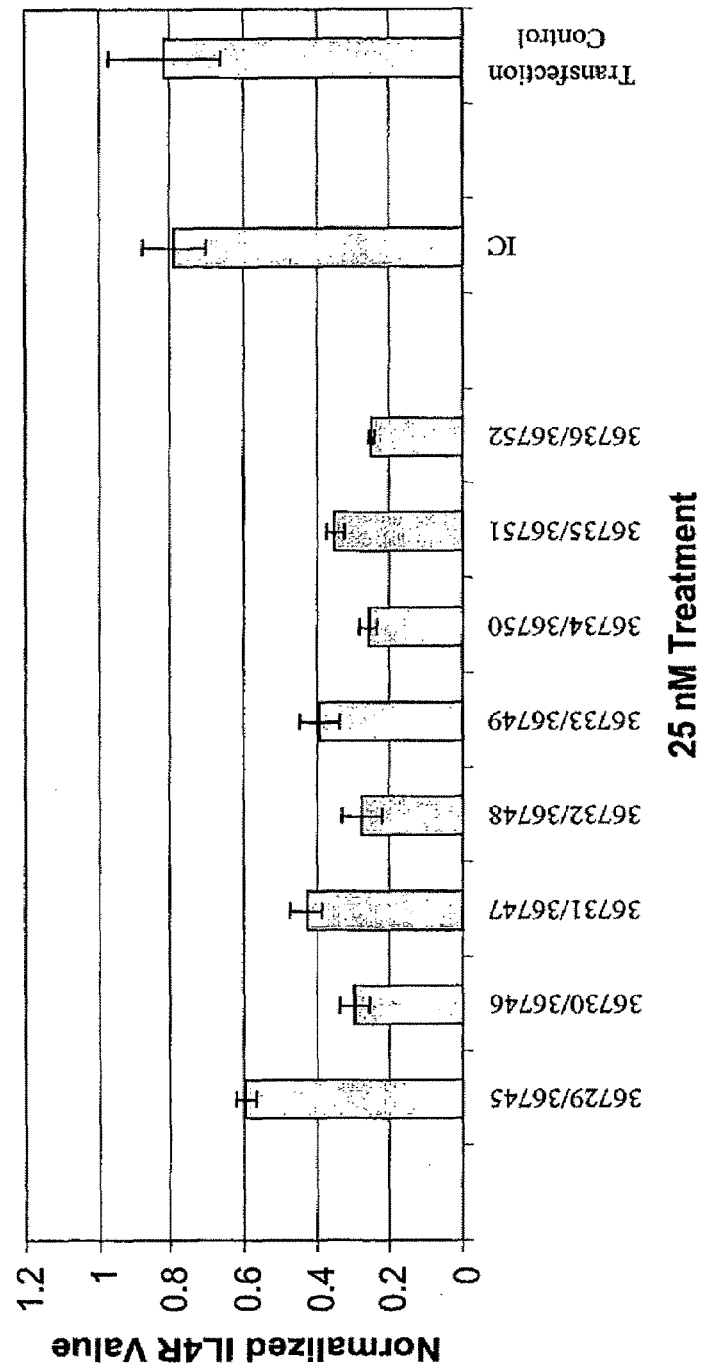

FIG. 22 shows a non-limiting example of reduction of IL-4R mRNA in HeLa cells mediated by siNAs that target IL-4R mRNA. HeLa cells were transfected with 0.25 ug/well of lipid complexed with 25 nM siNA. Active siNA constructs comprising Stab 9/22 stabilization chemistry were compared to matched chemistry irrelevant siNA control constructs (IC), and cells transfected with lipid alone (transfection control). As shown in the figure, the siNA constructs significantly reduce IL-4R RNA expression.

DETAILED DESCRIPTION OF THE INVENTION

Mechanism of Action of Nucleic Acid Molecules of the Invention

The discussion that follows discusses the proposed mechanism of RNA interference mediated by short interfering RNA as is presently known, and is not meant to be limiting and is not an admission of prior art. Applicant demonstrates herein that chemically-modified short interfering nucleic acids possess similar or improved capacity to mediate RNAi as do siRNA molecules and are expected to possess improved stability and activity in vivo; therefore, this discussion is not meant to be limiting only to siRNA and can be applied to siNA as a whole. By "improved capacity to mediate RNAi" or "improved RNAi activity" is meant to include RNAi activity measured in vitro and/or in vivo where the RNAi activity is a reflection of both the ability of the siNA to mediate RNAi and the stability of the siNAs of the invention. In this invention, the product of these activities can be increased in vitro and/or in vivo compared to an all RNA siRNA or an siNA containing a plurality of ribonucleotides. In some cases, the activity or stability of the siNA molecule can be decreased (i.e., less than ten-fold), but the overall activity of the siNA molecule is enhanced in vitro and/or in vivo.

RNA interference refers to the process of sequence specific post-transcriptional gene silencing in animals mediated by short interfering RNAs (siRNAs) (Fire et al., 1998, *Nature*, 391, 806). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes which is commonly shared by diverse flora and phyla (Fire et al., 1999, *Trends Genet.*, 15, 358). Such protection from foreign gene expression may have evolved in response to the production of double-stranded RNAs (dsRNAs) derived from viral infection or the random integration of transposon elements into a host genome via a cellular response that specifically destroys homologous single-stranded RNA or viral genomic RNA. The presence of dsRNA in cells triggers the RNAi response though a mechanism that has yet to be fully characterized. This mechanism appears to be different from the interferon response that results from dsRNA-mediated activation of protein kinase PKR and 2',5'-oligoadenylate synthetase resulting in non-specific cleavage of mRNA by ribonuclease L.

The presence of long dsRNAs in cells stimulates the activity of a ribonuclease III enzyme referred to as Dicer. Dicer is involved in the processing of the dsRNA into short pieces of dsRNA known as short interfering RNAs (siRNAs) (Berstein et al., 2001, *Nature*, 409, 363). Short interfering RNAs derived from Dicer activity are typically about 21 to about 23 nucleotides in length and comprise about 19 base pair duplexes. Dicer has also been implicated in the excision of 21- and 22-nucleotide small temporal RNAs (stRNAs) from precursor RNA of conserved structure that are implicated in translational control (Hutvagner et al., 2001, *Science*, 293, 834). The RNAi response also features an endonuclease complex containing an siRNA, commonly referred to as an RNA-induced silencing complex (RISC), which mediates cleavage of single-stranded RNA having sequence homologous to the siRNA. Cleavage of the target RNA takes place in the middle of the region complementary to the guide sequence of the siRNA duplex (Elbashir et al., 2001, *Genes Dev.*, 15, 188). In addition, RNA interference can also involve small RNA (e.g., micro-RNA or miRNA) mediated gene silencing, presumably though cellular mechanisms that regulate chromatin structure and thereby prevent transcription of target gene sequences (see for example Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). As such, siNA molecules of the invention can be used to mediate gene silencing via interaction with RNA transcripts or alternately by interaction with particular gene sequences, wherein such interaction results in gene silencing either at the transcriptional level or post-transcriptional level.

RNAi has been studied in a variety of systems. Fire et al., 1998, *Nature*, 391, 806, were the first to observe RNAi in *C. elegans*. Wianny and Goetz, 1999, *Nature Cell Biol.*, 2, 70, describe RNAi mediated by dsRNA in mouse embryos. Hammond et al., 2000, *Nature*, 404, 293, describe RNAi in *Drosophila* cells transfected with dsRNA. Elbashir et al., 2001, *Nature*, 411, 494, describe RNAi induced by introduction of duplexes of synthetic 21-nucleotide RNAs in cultured mammalian cells including human embryonic kidney and HeLa cells. Recent work in *Drosophila* embryonic lysates has revealed certain requirements for siRNA length, structure, chemical composition, and sequence that are essential to mediate efficient RNAi activity. These studies have shown that 21 nucleotide siRNA duplexes are most active when containing two 2-nucleotide 3'-terminal nucleotide overhangs. Furthermore, substitution of one or both siRNA strands with 2'-deoxy or 2'-O-methyl nucleotides abolishes RNAi activity, whereas substitution of 3'-terminal siRNA nucleotides with deoxy nucleotides was shown to be tolerated. Mismatch sequences in the center of the siRNA duplex were also shown to abolish RNAi activity. In addition, these studies also indicate that the position of the cleavage site in the target RNA is defined by the 5'-end of the siRNA guide sequence rather than the 3'-end (Elbashir et al., 2001, *EMBO J.*, 20, 6877). Other studies have indicated that a 5'-phosphate on the target-complementary strand of an siRNA duplex is required for siRNA activity and that ATP is utilized to maintain the 5'-phosphate moiety on the siRNA (Nykanen et al., 2001, *Cell*, 107, 309); however, siRNA molecules lacking a 5'-phosphate are active when introduced exogenously, suggesting that 5'-phosphorylation of siRNA constructs may occur in vivo.

Synthesis of Nucleic Acid Molecules

Synthesis of nucleic acids greater than 100 nucleotides in length is difficult using automated methods, and the therapeutic cost of such molecules is prohibitive. In this invention, small nucleic acid motifs ("small" refers to nucleic acid motifs no more than 100 nucleotides in length, preferably no more than 80 nucleotides in length, and most preferably no more than 50 nucleotides in length; e.g., individual siNA oligonucleotide sequences or siNA sequences synthesized in tandem) are preferably used for exogenous delivery. The simple structure of these molecules increases the ability of the nucleic acid to invade targeted regions of protein and/or RNA structure. Exemplary molecules of the instant invention are chemically synthesized, and others can similarly be synthesized.

Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.*, 74, 59, Brennan et al., 1998, *Biotechnol Bioeng.*, 61, 33-45, and Brennan, U.S. Pat. No. 6,001,311. All of these references are incorporated herein by reference. The synthesis of oligonucleotides makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 2.5 min coupling step for 2'-O-methylated nucleotides and a 45 second coupling step for 2'-deoxy nucleotides or 2'-deoxy-2'-fluoro nucleotides. Table V outlines the amounts and the contact times of the reagents used in the synthesis cycle. Alternatively, syntheses at the 0.2 μmol scale can be performed on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 105-fold excess of S-ethyl tetrazole (60 μL of 0.25 M=15 μmol) can be used in each coupling cycle of 2'-O-methyl residues relative to polymer-bound 5'-hydroxyl. A 22-fold excess (40 μL of 0.11 M=4.4 μmol) of deoxy phosphoramidite and a 70-fold excess of S-ethyl tetrazole (40 μL of 0.25 M=10 μmol) can be used in each coupling cycle of deoxy residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); and oxidation solution is 16.9 mM 12, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-benzodithiol-3-one 1,1-dioxide, 0.05 M in acetonitrile) is used.

Deprotection of the DNA-based oligonucleotides is performed as follows: the polymer-bound trityl-on oligoribonucleotide is transferred to a 4 mL glass screw top vial and suspended in a solution of 40% aqueous methylamine (1 mL) at 65° C. for 10 minutes. After cooling to −20° C., the supernatant is removed from the polymer support. The support is washed three times with 1.0 mL of EtOH:MeCN:H$_2$O/3:1:1, vortexed and the supernatant is then added to the first supernatant. The combined supernatants, containing the oligoribonucleotide, are dried to a white powder.

The method of synthesis used for RNA including certain siNA molecules of the invention follows the procedure as described in Usman et al., 1987, *J. Am. Chem. Soc.*, 109, 7845; Scaringe et al., 1990, *Nucleic Acids Res.*, 18, 5433; and Wincott et al., 1995, *Nucleic Acids Res.* 23, 2677-2684 Wincott et al., 1997, *Methods Mol. Bio.*, 74, 59, and makes use of common nucleic acid protecting and coupling groups, such as dimethoxytrityl at the 5'-end, and phosphoramidites at the 3'-end. In a non-limiting example, small scale syntheses are conducted on a 394 Applied Biosystems, Inc. synthesizer using a 0.2 μmol scale protocol with a 7.5 min coupling step for alkylsilyl protected nucleotides and a 2.5 min coupling step for 2'-O-methylated nucleotides. Table V outlines the amounts and the contact times of the reagents used in the synthesis cycle. Alternatively, syntheses at the 0.2 μmol scale can be done on a 96-well plate synthesizer, such as the instrument produced by Protogene (Palo Alto, Calif.) with minimal modification to the cycle. A 33-fold excess (60 μL of 0.11 M=6.6 μmol) of 2'-O-methyl phosphoramidite and a 75-fold excess of S-ethyl tetrazole (60 μL of 0.25 M=15 μmol) can be used in each coupling cycle of 2'-O-methyl residues relative to polymer-bound 5'-hydroxyl. A 66-fold excess (120 μL of 0.11 M=13.2 μmol) of alkylsilyl (ribo) protected phosphoramidite and a 150-fold excess of S-ethyl tetrazole (120 μL of 0.25 M=30 μmol) can be used in each coupling cycle of ribo residues relative to polymer-bound 5'-hydroxyl. Average coupling yields on the 394 Applied Biosystems, Inc. synthesizer, determined by colorimetric quantitation of the trityl fractions, are typically 97.5-99%. Other oligonucleotide synthesis reagents for the 394 Applied Biosystems, Inc. synthesizer include the following: detritylation solution is 3% TCA in methylene chloride (ABI); capping is performed with 16% N-methyl imidazole in THF (ABI) and 10% acetic anhydride/10% 2,6-lutidine in THF (ABI); oxidation solution is 16.9 mM 12, 49 mM pyridine, 9% water in THF (PerSeptive Biosystems, Inc.). Burdick & Jackson Synthesis Grade acetonitrile is used directly from the reagent bottle. S-Ethyltetrazole solution (0.25 M in acetonitrile) is made up from the solid obtained from American International Chemical, Inc. Alternately, for the introduction of phosphorothioate linkages, Beaucage reagent (3H-1,2-benzodithiol-3-one 1,1-dioxide, 0.05 M in acetonitrile) is used.

Deprotection of the RNA is performed using either a two-pot or one-pot protocol. For the two-pot protocol, the polymer-bound trityl-on oligoribonucleotide is transferred to a 4 mL glass screw top vial and suspended in a solution of 40% aq. methylamine (1 mL) at 65° C. for 10 min. After cooling to −20° C., the supernatant is removed from the polymer support. The support is washed three times with 1.0 mL of EtOH:MeCN:H2O/3:1:1, vortexed and the supernatant is then added to the first supernatant. The combined supernatants, containing the oligoribonucleotide, are dried to a white powder. The base deprotected oligoribonucleotide is resuspended in anhydrous TEA/HF/NMP solution (300 μL of a solution of 1.5 mL N-methylpyrrolidinone, 750 μL TEA and 1 mL TEA·3HF to provide a 1.4 M HF concentration) and heated to 65° C. After 1.5 h, the oligomer is quenched with 1.5 M NH$_4$HCO$_3$.

Alternatively, for the one-pot protocol, the polymer-bound trityl-on oligoribonucleotide is transferred to a 4 mL glass screw top vial and suspended in a solution of 33% ethanolic methylamine/DMSO:1/1 (0.8 mL) at 65° C. for 15 minutes. The vial is brought to room temperature TEA·3HF (0.1 mL) is added and the vial is heated at 65° C. for 15 minutes. The sample is cooled at −20° C. and then quenched with 1.5 M NH$_4$HCO$_3$.

For purification of the trityl-on oligomers, the quenched NH$_4$HCO$_3$ solution is loaded onto a C-18 containing cartridge that had been prewashed with acetonitrile followed by 50 mM TEAA. After washing the loaded cartridge with water, the RNA is detritylated with 0.5% TFA for 13 minutes. The cartridge is then washed again with water, salt exchanged with 1 M NaCl and washed with water again. The oligonucleotide is then eluted with 30% acetonitrile.

The average stepwise coupling yields are typically >98% (Wincott et al., 1995 *Nucleic Acids Res.* 23, 2677-2684). Those of ordinary skill in the art will recognize that the scale of synthesis can be adapted to be larger or smaller than the example described above including but not limited to 96-well format.

Alternatively, the nucleic acid molecules of the present invention can be synthesized separately and joined together post-synthetically, for example, by ligation (Moore et al., 1992, *Science* 256, 9923; Draper et al., International PCT publication No. WO 93/23569; Shabarova et al., 1991, *Nucleic Acids Research* 19, 4247; Bellon et al., 1997, *Nucleosides & Nucleotides,* 16, 951; Bellon et al., 1997, *Bioconjugate Chem.* 8, 204), or by hybridization following synthesis and/or deprotection.

The siNA molecules of the invention can also be synthesized via a tandem synthesis methodology as described in Example 1 herein, wherein both siNA strands are synthesized as a single contiguous oligonucleotide fragment or strand separated by a cleavable linker which is subsequently cleaved to provide separate siNA fragments or strands that hybridize and permit purification of the siNA duplex. The linker can be a polynucleotide linker or a non-nucleotide linker. The tandem synthesis of siNA as described herein can be readily adapted to both multiwell/multiplate synthesis platforms such as 96 well or similarly larger multi-well platforms. The tandem synthesis of siNA as described herein can also be readily adapted to large scale synthesis platforms employing batch reactors, synthesis columns and the like.

An siNA molecule can also be assembled from two distinct nucleic acid strands or fragments wherein one fragment includes the sense region and the second fragment includes the antisense region of the RNA molecule.

The nucleic acid molecules of the present invention can be modified extensively to enhance stability by modification with nuclease resistant groups, for example, 2'-amino, 2'-C-allyl, 2'-fluoro, 2'-O-methyl, 2'-H (for a review see Usman and Cedergren, 1992, *TIBS* 17, 34; Usman et al., 1994, *Nucleic Acids Symp. Ser.* 31, 163). siNA constructs can be purified by gel electrophoresis using general methods or can be purified by high pressure liquid chromatography (HPLC; see Wincott et al., supra, the totality of which is hereby incorporated herein by reference) and re-suspended in water.

In another aspect of the invention, siNA molecules of the invention are expressed from transcription units inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. The recombinant vectors capable of expressing the siNA molecules can be delivered as described herein, and persist in target cells. Alternatively, viral vectors can be used that provide for transient expression of siNA molecules.

Optimizing Activity of the Nucleic Acid Molecule of the Invention.

Chemically synthesizing nucleic acid molecules with modifications (base, sugar and/or phosphate) can prevent their degradation by serum ribonucleases, which can increase their potency (see e.g., Eckstein et al., International Publication No. WO 92/07065; Perrault et al., 1990 *Nature* 344, 565; Pieken et al., 1991, *Science* 253, 314; Usman and Cedergren, 1992, *Trends in Biochem. Sci.* 17, 334; Usman et al., International Publication No. WO 93/15187; and Rossi et al., International Publication No. WO 91/03162; Sproat, U.S. Pat. No. 5,334,711; Gold et al., U.S. Pat. No. 6,300,074; and Burgin et al., supra; all of which are incorporated by reference herein). All of the above references describe various chemical modifications that can be made to the base, phosphate and/or sugar moieties of the nucleic acid molecules described herein. Modifications that enhance their efficacy in cells, and removal of bases from nucleic acid molecules to shorten oligonucleotide synthesis times and reduce chemical requirements are desired.

There are several examples in the art describing sugar, base and phosphate modifications that can be introduced into nucleic acid molecules with significant enhancement in their nuclease stability and efficacy. For example, oligonucleotides are modified to enhance stability and/or enhance biological activity by modification with nuclease resistant groups, for example, 2'-amino, 2'-C-allyl, 2'-fluoro, 2'-O-methyl, 2'-O-allyl, 2'-H, nucleotide base modifications (for a review see Usman and Cedergren, 1992, *TIBS*. 17, 34; Usman et al., 1994, *Nucleic Acids Symp. Ser.* 31, 163; Burgin et al., 1996, *Biochemistry*, 35, 14090). Sugar modification of nucleic acid molecules have been extensively described in the art (see Eckstein et al., International Publication PCT No. WO 92/07065; Perrault et al. *Nature*, 1990, 344, 565-568; Pieken et al. *Science*, 1991, 253, 314-317; Usman and Cedergren, *Trends in Biochem. Sci.*, 1992, 17, 334-339; Usman et al. International Publication PCT No. WO 93/15187; Sproat, U.S. Pat. No. 5,334,711 and Beigelman et al., 1995, *J. Biol. Chem.*, 270, 25702; Beigelman et al., International PCT publication No. WO 97/26270; Beigelman et al., U.S. Pat. No. 5,716,824; Usman et al., U.S. Pat. No. 5,627,053; Woolf et al., International PCT Publication No. WO 98/13526; Thompson et al., U.S. Ser. No. 60/082,404 which was filed on Apr. 20, 1998; Karpeisky et al., 1998, *Tetrahedron Lett.*, 39, 1131; Earnshaw and Gait, 1998, *Biopolymers (Nucleic Acid Sciences)*, 48, 39-55; Verma and Eckstein, 1998, *Annu. Rev. Biochem.*, 67, 99-134; and Burlina et al., 1997, *Bioorg. Med. Chem.*, 5, 1999-2010; all of the references are hereby incorporated in their totality by reference herein). Such publications describe general methods and strategies to determine the location of incorporation of sugar, base and/or phosphate modifications and the like into nucleic acid molecules without modulating catalysis, and are incorporated by reference herein. In view of such teachings, similar modifications can be used as described herein to modify the siNA nucleic acid molecules of the instant invention so long as the ability of siNA to promote RNAi is cells is not significantly inhibited.

While chemical modification of oligonucleotide internucleotide linkages with phosphorothioate, phosphorodithioate, and/or 5'-methylphosphonate linkages improves stability, excessive modifications can cause some toxicity or decreased activity. Therefore, when designing nucleic acid molecules, the amount of these internucleotide linkages should be minimized. The reduction in the concentration of these linkages should lower toxicity, resulting in increased efficacy and higher specificity of these molecules.

Short interfering nucleic acid (siNA) molecules having chemical modifications that maintain or enhance activity are provided. Such a nucleic acid is also generally more resistant to nucleases than an unmodified nucleic acid. Accordingly, the in vitro and/or in vivo activity should not be significantly lowered. In cases in which modulation is the goal, therapeutic nucleic acid molecules delivered exogenously should optimally be stable within cells until translation of the target RNA has been modulated long enough to reduce the levels of the undesirable protein. This period of time varies between hours to days depending upon the disease state. Improvements in the chemical synthesis of RNA and DNA (Wincott et al., 1995, *Nucleic Acids Res.* 23, 2677; Caruthers et al., 1992, *Methods in Enzymology* 211, 3-19 (incorporated by reference herein)) have expanded the ability to modify nucleic acid molecules by introducing nucleotide modifications to enhance their nuclease stability, as described above.

In one embodiment, nucleic acid molecules of the invention include one or more (e.g., about 1, 2, 3, 4, 5, 6, 7, 8, 9, 10, or more) G-clamp nucleotides. A G-clamp nucleotide is a modified cytosine analog wherein the modifications confer the ability to hydrogen bond both Watson-Crick and Hoogsteen faces of a complementary guanine within a duplex, see for example Lin and Matteucci, 1998, *J. Am. Chem. Soc.*, 120, 8531-8532. A single G-clamp analog substitution within an oligonucleotide can result in substantially enhanced helical thermal stability and mismatch discrimination when hybridized to complementary oligonucleotides. The inclusion of such nucleotides in nucleic acid molecules of the invention results in both enhanced affinity and specificity to nucleic acid targets, complementary sequences, or template strands. In another embodiment, nucleic acid molecules of the invention include one or more (e.g., about 1, 2, 3, 4, 5, 6, 7, 8, 9, 10, or more) LNA "locked nucleic acid" nucleotides such as a 2',4'-C methylene bicyclo nucleotide (see for example Wengel et al., International PCT Publication No. WO 00/66604 and WO 99/14226).

In another embodiment, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. The present invention encompasses the design and synthesis of novel conjugates and complexes for the delivery of molecules, including, but not limited to, small molecules, lipids, cholesterol, phospholipids, nucleosides, nucleotides, nucleic acids, antibodies, toxins, negatively charged polymers and other polymers, for example proteins, peptides, hormones, carbohydrates, polyethylene glycols, or polyamines, across cellular membranes. In general, the transporters described are designed to be used either individually or as part of a multi-component system, with or without degradable linkers. These compounds are expected to improve delivery and/or localization of nucleic acid molecules of the invention into a number of cell types originating from different tissues, in the presence or absence of serum (see Sullenger and Cech, U.S. Pat. No. 5,854,038). Conjugates of the molecules described herein can be attached to biologically active molecules via linkers that are biodegradable, such as biodegradable nucleic acid linker molecules.

The term "biodegradable linker" as used herein, refers to a nucleic acid or non-nucleic acid linker molecule that is designed as a biodegradable linker to connect one molecule to another molecule, for example, a biologically active molecule to an siNA molecule of the invention or the sense and antisense strands of an siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically-modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The term "biodegradable" as used herein, refers to degradation in a biological system, for example enzymatic degradation or chemical degradation.

The term "biologically active molecule" as used herein, refers to compounds or molecules that are capable of eliciting or modifying a biological response in a system. Non-limiting examples of biologically active siNA molecules either alone or in combination with other molecules contemplated by the instant invention include therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, 2,5-A chimeras, siNA, dsRNA, allozymes, aptamers, decoys and analogs thereof. Biologically active molecules of the invention also include molecules capable of modulating the pharmacokinetics and/or pharmacodynamics of other biologically active molecules, for example, lipids and polymers such as polyamines, polyamides, polyethylene glycol and other polyethers.

The term "phospholipid" as used herein, refers to a hydrophobic molecule comprising at least one phosphorus group. For example, a phospholipid can comprise a phosphorus-containing group and saturated or unsaturated alkyl group, optionally substituted with OH, COOH, oxo, amine, or substituted or unsubstituted aryl groups.

Therapeutic nucleic acid molecules (e.g., siNA molecules) delivered exogenously optimally are stable within cells until reverse transcription of the RNA has been modulated long enough to reduce the levels of the RNA transcript. The nucleic acid molecules are resistant to nucleases in order to function as effective intracellular therapeutic agents. Improvements in the chemical synthesis of nucleic acid molecules described in the instant invention and in the art have expanded the ability to modify nucleic acid molecules by introducing nucleotide modifications to enhance their nuclease stability as described above.

In yet another embodiment, siNA molecules having chemical modifications that maintain or enhance enzymatic activity of proteins involved in RNAi are provided. Such nucleic acids are also generally more resistant to nucleases than unmodified nucleic acids. Thus, in vitro and/or in vivo the activity should not be significantly lowered.

Use of the nucleic acid-based molecules of the invention will lead to better treatments by affording the possibility of combination therapies (e.g., multiple siNA molecules targeted to different genes; nucleic acid molecules coupled with known small molecule modulators; or intermittent treatment with combinations of molecules, including different motifs and/or other chemical or biological molecules). The treatment of subjects with siNA molecules can also include combinations of different types of nucleic acid molecules, such as enzymatic nucleic acid molecules (ribozymes), allozymes, antisense, 2,5-A oligoadenylate, decoys, and aptamers.

In another aspect an siNA molecule of the invention comprises one or more 5' and/or a 3'-cap structure, for example on only the sense siNA strand, the antisense siNA strand, or both siNA strands.

By "cap structure" is meant chemical modifications, which have been incorporated at either terminus of the oligonucleotide (see, for example, Adamic et al., U.S. Pat. No. 5,998, 203, incorporated by reference herein). These terminal modifications protect the nucleic acid molecule from exonuclease degradation, and may help in delivery and/or localization within a cell. The cap may be present at the 5'-terminus (5'-cap) or at the 3'-terminal (3'-cap) or may be present on both termini. In non-limiting examples, the 5'-cap includes, but is not limited to, glyceryl, inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide, 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety.

Non-limiting examples of the 3'-cap include, but are not limited to, glyceryl, inverted deoxy abasic residue (moiety), 4',5'-methylene nucleotide; 1-(beta-D-erythrofuranosyl) nucleotide; 4'-thio nucleotide, carbocyclic nucleotide;

5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate, phosphorothioate and/or phosphorodithioate, bridging or non bridging methylphosphonate and 5'-mercapto moieties (for more details see Beaucage and Iyer, 1993, *Tetrahedron* 49, 1925; incorporated by reference herein).

By the term "non-nucleotide" is meant any group or compound which can be incorporated into a nucleic acid chain in the place of one or more nucleotide units, including either sugar and/or phosphate substitutions, and allows the remaining bases to exhibit their enzymatic activity. The group or compound is abasic in that it does not contain a commonly recognized nucleotide base, such as adenosine, guanine, cytosine, uracil or thymine and therefore lacks a base at the 1'-position.

An "alkyl" group refers to a saturated aliphatic hydrocarbon, including straight-chain, branched-chain, and cyclic alkyl groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted the substituted group(s) is preferably, hydroxyl, cyano, alkoxy, =O, =S, $NO_2$ or $N(CH_3)_2$, amino, or SH. The term also includes alkenyl groups that are unsaturated hydrocarbon groups containing at least one carbon-carbon double bond, including straight-chain, branched-chain, and cyclic groups. Preferably, the alkenyl group has 1 to 12 carbons. More preferably, it is a lower alkenyl of from 1 to 7 carbons, more preferably 1 to 4 carbons. The alkenyl group may be substituted or unsubstituted. When substituted the substituted group(s) is preferably, hydroxyl, cyano, alkoxy, =O, =S, $NO_2$, halogen, $N(CH_3)_2$, amino, or SH. The term "alkyl" also includes alkynyl groups that have an unsaturated hydrocarbon group containing at least one carbon-carbon triple bond, including straight-chain, branched-chain, and cyclic groups. Preferably, the alkynyl group has 1 to 12 carbons. More preferably, it is a lower alkynyl of from 1 to 7 carbons, more preferably 1 to 4 carbons. The alkynyl group may be substituted or unsubstituted. When substituted the substituted group(s) is preferably, hydroxyl, cyano, alkoxy, =O, =S, $NO_2$ or $N(CH_3)_2$, amino or SH.

Such alkyl groups can also include aryl, alkylaryl, carbocyclic aryl, heterocyclic aryl, amide and ester groups. An "aryl" group refers to an aromatic group that has at least one ring having a conjugated pi electron system and includes carbocyclic aryl, heterocyclic aryl and biaryl groups, all of which may be optionally substituted. The preferred substituent(s) of aryl groups are halogen, trihalomethyl, hydroxyl, SH, OH, cyano, alkoxy, alkyl, alkenyl, alkynyl, and amino groups. An "alkylaryl" group refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and suitable heterocyclic groups include furanyl, thienyl, pyridyl, pyrrolyl, N-lower alkyl pyrrolo, pyrimidyl, pyrazinyl, imidazolyl and the like, all optionally substituted. An "amide" refers to an —C(O)—NH—R, where R is either alkyl, aryl, alkylaryl or hydrogen. An "ester" refers to an —C(O)—OR', where R is either alkyl, aryl, alkylaryl or hydrogen.

"Nucleotide" as used herein, and as recognized in the art, includes natural bases (standard), and modified bases well known in the art. Such bases are generally located at the 1' position of a nucleotide sugar moiety. Nucleotides generally comprise a base, sugar and a phosphate group. The nucleotides can be unmodified or modified at the sugar, phosphate and/or base moiety, (also referred to interchangeably as nucleotide analogs, modified nucleotides, non-natural nucleotides, non-standard nucleotides and other; see, for example, Usman and McSwiggen, supra; Eckstein et al., International PCT Publication No. WO 92/07065; Usman et al., International PCT Publication No. WO 93/15187; Uhlman & Peyman, supra, all are hereby incorporated by reference herein). There are several examples of modified nucleic acid bases known in the art as summarized by Limbach et al., 1994, *Nucleic Acids Res.* 22, 2183. Some of the non-limiting examples of base modifications that can be introduced into nucleic acid molecules include, inosine, purine, pyridin-4-one, pyridin-2-one, phenyl, pseudouracil, 2,4,6-trimethoxy benzene, 3-methyl uracil, dihydrouridine, naphthyl, aminophenyl, 5-alkylcytidines (e.g., 5-methylcytidine), 5-alkyluridines (e.g., ribothymidine), 5-halouridine (e.g., 5-bromouridine) or 6-azapyrimidines or 6-alkylpyrimidines (e.g. 6-methyluridine), propyne, and others (Burgin et al., 1996, *Biochemistry*, 35, 14090; Uhlman & Peyman, supra). By "modified bases" in this aspect is meant nucleotide bases other than adenine, guanine, cytosine and uracil at 1' position or their equivalents.

In one embodiment, the invention features modified siNA molecules, with phosphate backbone modifications comprising one or more phosphorothioate, phosphorodithioate, methylphosphonate, phosphotriester, morpholino, amidate carbamate, carboxymethyl, acetamidate, polyamide, sulfonate, sulfonamide, sulfamate, formacetal, thioformacetal, and/or alkylsilyl, substitutions. For a review of oligonucleotide backbone modifications, see Hunziker and Leumann, 1995, *Nucleic Acid Analogues: Synthesis and Properties, in Modern Synthetic Methods*, VCH, 331-417, and Mesmaeker et al., 1994, *Novel Backbone Replacements for Oligonucleotides, in Carbohydrate Modifications in Antisense Research*, ACS, 24-39.

By "abasic" is meant sugar moieties lacking a base or having other chemical groups in place of a base at the 1' position, see for example Adamic et al., U.S. Pat. No. 5,998, 203.

By "unmodified nucleoside" is meant one of the bases adenine, cytosine, guanine, thymine, or uracil joined to the 1 carbon of β-D-ribo-furanose.

By "modified nucleoside" is meant any nucleotide base which contains a modification in the chemical structure of an unmodified nucleotide base, sugar and/or phosphate. Non-limiting examples of modified nucleotides are shown by Formulae I-VII and/or other modifications described herein.

In connection with 2'-modified nucleotides as described for the present invention, by "amino" is meant 2'—$NH_2$ or 2'-O—$NH_2$, which can be modified or unmodified. Such modified groups are described, for example, in Eckstein et al., U.S. Pat. No. 5,672,695 and Matulic-Adamic et al., U.S. Pat. No. 6,248,878, which are both incorporated by reference in their entireties.

Various modifications to nucleic acid siNA structure can be made to enhance the utility of these molecules. Such modifications will enhance shelf-life, half-life in vitro, stability, and ease of introduction of such oligonucleotides to the target site, e.g., to enhance penetration of cellular membranes, and confer the ability to recognize and bind to targeted cells.

Administration of Nucleic Acid Molecules

An siNA molecule of the invention can be adapted for use to prevent or treat cancers and other proliferative conditions, viral infection, inflammatory disease, autoimmunity, respiratory disease, pulmonary disease, cardiovascular disease, neurological disease, renal disease, ocular disease, liver disease, mitochondrial disease, endocrine disease, prion disease, reproduction related diseases and conditions, and/or any other trait, disease or condition that is related to or will respond to the levels of interleukin and/or interleukin receptor in a cell or tissue, alone or in combination with other therapies. For example, an siNA molecule can comprise a delivery vehicle, including liposomes, for administration to a subject, carriers and diluents and their salts, and/or can be present in pharmaceutically acceptable formulations. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192, all of which are incorporated herein by reference. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example Gonzalez et al., 1999, *Bioconjugate Chem.*, 10, 1068-1074; Wang et al., International PCT publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722). In another embodiment, the nucleic acid molecules of the invention can also be formulated or complexed with polyethyleneimine and derivatives thereof, such as polyethyleneimine-polyethyleneglycol-N-acetylgalactosamine (PEI-PEG-GAL) or polyethyleneimine-polyethyleneglycol-tri-N-acetylgalactosamine (PEI-PEG-triGAL) derivatives.

In one embodiment, an siNA molecule of the invention is complexed with membrane disruptive agents such as those described in U.S. Patent Application Publication No. 20010007666, incorporated by reference herein in its entirety including the drawings. In another embodiment, the membrane disruptive agent or agents and the siNA molecule are also complexed with a cationic lipid or helper lipid molecule, such as those lipids described in U.S. Pat. No. 6,235,310, incorporated by reference herein in its entirety including the drawings.

In one embodiment, an siNA molecule of the invention is complexed with delivery systems as described in U.S. Patent Application Publication No. 2003077829 and International PCT Publication Nos. WO 00/03683 and WO 02/087541, all incorporated by reference herein in their entirety including the drawings.

In addition, the invention features the use of methods to deliver the nucleic acid molecules of the instant invention to the central nervous system and/or peripheral nervous system. Experiments have demonstrated the efficient in vivo uptake of nucleic acids by neurons. As an example of local administration of nucleic acids to nerve cells, Sommer et al., 1998, *Antisense Nuc. Acid Drug Dev.*, 8, 75, describe a study in which a 15mer phosphorothioate antisense nucleic acid molecule to c-fos is administered to rats via microinjection into the brain. Antisense molecules labeled with tetramethyl-rhodamine-isothiocyanate (TRITC) or fluorescein isothiocyanate (FITC) were taken up by exclusively by neurons thirty minutes post-injection. A diffuse cytoplasmic staining and nuclear staining was observed in these cells. As an example of systemic administration of nucleic acid to nerve cells, Epa et al., 2000, *Antisense Nuc. Acid Drug Dev.*, 10, 469, describe an in vivo mouse study in which beta-cyclodextrin-adamantane-oligonucleotide conjugates were used to target the p75 neurotrophin receptor in neuronally differentiated PC12 cells. Following a two week course of IP administration, pronounced uptake of p75 neurotrophin receptor antisense was observed in dorsal root ganglion (DRG) cells. In addition, a marked and consistent down-regulation of p75 was observed in DRG neurons. Additional approaches to the targeting of nucleic acid to neurons are described in Broaddus et al., 1998, *J. Neurosurg.*, 88(4), 734; Karle et al., 1997, *Eur. J. Pharmocol.*, 340(2/3), 153; Bannai et al., 1998, *Brain Research*, 784 (1, 2), 304; Rajakumar et al., 1997, *Synapse*, 26(3), 199; Wu-pong et al., 1999, *BioPharm*, 12(1), 32; Bannai et al., 1998, *Brain Res. Protoc.*, 3(1), 83; Simantov et al., 1996, *Neuroscience*, 74(1), 39. Nucleic acid molecules of the invention are therefore amenable to delivery to and uptake by cells that express repeat expansion allelic variants for modulation of RE gene expression. The delivery of nucleic acid molecules of the invention, targeting RE is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

In addition, the invention features the use of methods to deliver the nucleic acid molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood*, 91(3), 852-862; Filion and Phillips, 1997, *Biochim. Biophys. Acta.*, 1329(2), 345-356; Ma and Wei, 1996, *Leuk. Res.*, 20(11/12), 925-930; and Bongartz et al., 1994, *Nucleic Acids Research*, 22(22), 4681-8. Such methods, as described above, include the use of free oligonucleotide, cationic lipid formulations, liposome formulations including pH sensitive liposomes and immunoliposomes, and bioconjugates including oligonucleotides conjugated to fusogenic peptides, for the transfection of hematopoietic cells with oligonucleotides.

In one embodiment, a compound, molecule, or composition for the treatment of ocular conditions (e.g., macular degeneration, diabetic retinopathy etc.) is administered to a subject intraocularly or by intraocular means. In another embodiment, a compound, molecule, or composition for the treatment of ocular conditions (e.g., macular degeneration, diabetic retinopathy etc.) is administered to a subject periocularly or by periocular means (see for example Ahlheim et al., International PCT publication No. WO 03/24420). In one embodiment, an siNA molecule and/or formulation or composition thereof is administered to a subject intraocularly or by intraocular means. In another embodiment, an siNA molecule and/or formulation or composition thereof is administered to a subject periocularly or by periocular means. Periocular administration generally provides a less invasive approach to administering siNA molecules and formulation or composition thereof to a subject (see for example Ahlheim et al., International PCT publication No. WO 03/24420). The use of periocular administration also minimizes the risk of retinal detachment, allows for more frequent dosing or administration, provides a clinically relevant route of administration for macular degeneration and other optic conditions, and also provides the possibility of using reservoirs (e.g., implants, pumps or other devices) for drug delivery.

In one embodiment, the siNA molecules of the invention and formulations or compositions thereof are administered directly or topically (e.g., locally) to the dermis or follicles as is generally known in the art (see for example Brand, 2001, *Curr. Opin. Mol. Ther.*, 3, 244-8; Regnier et al., 1998, *J. Drug Target*, 5, 275-89; Kanikkannan, 2002, *BioDrugs*, 16, 339-47; Wraight et al., 2001, *Pharmacol. Ther.*, 90, 89-104; and Preat and Dujardin, 2001, STP PharmaSciences, 11, 57-68.

In one embodiment, dermal delivery systems of the invention include, for example, aqueous and nonaqueous gels, creams, multiple emulsions, microemulsions, liposomes, ointments, aqueous and nonaqueous solutions, lotions, aerosols, hydrocarbon bases and powders, and can contain excipients such as solubilizers, permeation enhancers (e.g., fatty acids, fatty acid esters, fatty alcohols and amino acids), and hydrophilic polymers (e.g., polycarbophil and polyvinylpyrolidone). In one embodiment, the pharmaceutically acceptable carrier is a liposome or a transdermal enhancer. Examples of liposomes which can be used in this invention include the following: (1) CellFectin, 1:1.5 (M/M) liposome formulation of the cationic lipid N,NI,NII,NIII-tetramethyl-N,NI,NII,NIII-tetrapalmit-y-spermine and dioleoyl phosphatidylethanolamine (DOPE) (GIBCO BRL); (2) Cytofectin GSV, 2:1 (M/M) liposome formulation of a cationic lipid and DOPE (Glen Research); (3) DOTAP (N-[1-(2,3-dioleoyloxy)-N,N,N-tri-methyl-ammoniummethylsulfate) (Boehringer Manheim); and (4) Lipofectamine, 3:1 (M/M) liposome formulation of the polycationic lipid DOSPA and the neutral lipid DOPE (GIBCO BRL).

In one embodiment, transmucosal delivery systems of the invention include patches, tablets, suppositories, pessaries, gels and creams, and can contain excipients such as solubilizers and enhancers (e.g., propylene glycol, bile salts and amino acids), and other vehicles (e.g., polyethylene glycol, fatty acid esters and derivatives, and hydrophilic polymers such as hydroxypropylmethylcellulose and hyaluronic acid).

In one embodiment, nucleic acid molecules of the invention are administered to the central nervous system (CNS) or peripheral nervous system (PNS). Experiments have demonstrated the efficient in vivo uptake of nucleic acids by neurons. As an example of local administration of nucleic acids to nerve cells, Sommer et al., 1998, *Antisense Nuc. Acid Drug Dev.*, 8, 75, describe a study in which a 15mer phosphorothioate antisense nucleic acid molecule to c-fos is administered to rats via microinjection into the brain. Antisense molecules labeled with tetramethylrhodamine-isothiocyanate (TRITC) or fluorescein isothiocyanate (FITC) were taken up by exclusively by neurons thirty minutes post-injection. A diffuse cytoplasmic staining and nuclear staining was observed in these cells. As an example of systemic administration of nucleic acid to nerve cells, Epa et al., 2000, *Antisense Nuc. Acid Drug Dev.*, 10, 469, describe an in vivo mouse study in which beta-cyclodextrin-adamantane-oligonucleotide conjugates were used to target the p75 neurotrophin receptor in neuronally differentiated PC12 cells. Following a two week course of IP administration, pronounced uptake of p75 neurotrophin receptor antisense was observed in dorsal root ganglion (DRG) cells. In addition, a marked and consistent down-regulation of p75 was observed in DRG neurons. Additional approaches to the targeting of nucleic acid to neurons are described in Broaddus et al., 1998, *J. Neurosurg.*, 88(4), 734; Karle et al., 1997, *Eur. J. Pharmocol.*, 340(2/3), 153; Bannai et al., 1998, *Brain Research*, 784(1, 2), 304; Rajakumar et al., 1997, *Synapse*, 26(3), 199; Wu-pong et al., 1999, *BioPharm*, 12(1), 32; Bannai et al., 1998, *Brain Res. Protoc.*, 3(1), 83; Simantov et al., 1996, *Neuroscience*, 74(1), 39. Nucleic acid molecules of the invention are therefore amenable to delivery to and uptake by cells in the CNS and/or PNS.

The delivery of nucleic acid molecules of the invention to the CNS is provided by a variety of different strategies. Traditional approaches to CNS delivery that can be used include, but are not limited to, intrathecal and intracerebroventricular administration, implantation of catheters and pumps, direct injection or perfusion at the site of injury or lesion, injection into the brain arterial system, or by chemical or osmotic opening of the blood-brain barrier. Other approaches can include the use of various transport and carrier systems, for example though the use of conjugates and biodegradable polymers. Furthermore, gene therapy approaches, for example as described in Kaplitt et al., U.S. Pat. No. 6,180,613 and Davidson, WO 04/013280, can be used to express nucleic acid molecules in the CNS.

In one embodiment, the nucleic acid molecules of the invention are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the nucleic acid compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Aerosols of liquid particles comprising a nucleic acid composition of the invention can be produced by any suitable means, such as with a nebulizer (see for example U.S. Pat. No. 4,501,729). Nebulizers are commercially available devices which transform solutions or suspensions of an active ingredient into a therapeutic aerosol mist either by means of acceleration of a compressed gas, typically air or oxygen, through a narrow venturi orifice or by means of ultrasonic agitation. Suitable formulations for use in nebulizers comprise the active ingredient in a liquid carrier in an amount of up to 40% w/w preferably less than 20% w/w of the formulation. The carrier is typically water or a dilute aqueous alcoholic solution, preferably made isotonic with body fluids by the addition of, for example, sodium chloride or other suitable salts. Optional additives include preservatives if the formulation is not prepared sterile, for example, methyl hydroxybenzoate, anti-oxidants, flavorings, volatile oils, buffering agents and emulsifiers and other formulation surfactants. The aerosols of solid particles comprising the active composition and surfactant can likewise be produced with any solid particulate aerosol generator. Aerosol generators for administering solid particulate therapeutics to a subject produce particles which are respirable, as explained above, and generate a volume of aerosol containing a predetermined metered dose of a therapeutic composition at a rate suitable for human administration. One illustrative type of solid particulate aerosol generator is an insufflator. Suitable formulations for administration by insufflation include finely comminuted powders which can be delivered by means of an insufflator. In the insufflator, the powder, e.g., a metered dose thereof effective to carry out the treatments described herein, is contained in capsules or cartridges, typically made of gelatin or plastic, which are either pierced or opened in situ and the powder delivered by air drawn through the device upon inhalation or by means of a manually-operated pump. The powder employed in the insufflator consists either solely of the active ingredient or of a powder blend comprising the active ingredient, a suitable powder diluent, such as lactose, and an optional surfactant. The active ingredient typically comprises from 0.1 to 100 w/w of the formulation. A second type of illustrative aerosol generator comprises a metered dose inhaler. Metered dose inhalers are pressurized aerosol dispensers, typically containing a suspension or solution formulation of the active ingredient in a liquefied propellant. During use these devices discharge the formulation through a valve adapted to deliver a metered volume to produce a fine particle spray containing the active ingredient. Suitable propellants include certain chlorofluorocarbon compounds, for example, dichlorodifluoromethane, trichlorofluoromethane, dichlorotetrafluoroethane and mixtures thereof. The formulation can additionally contain one or more co-solvents, for example, ethanol, emulsifiers and other formulation surfactants, such as oleic acid or sorbitan trioleate, anti-oxidants and suitable flavoring agents. Other methods for pulmonary delivery are described in, for example US Patent Application No. 20040037780, and U.S. Pat. Nos. 6,592,904; 6,582,728; 6,565,885.

In one embodiment, siNA molecules of the invention are formulated or complexed with polyethylenimine (e.g., linear or branched PEI) and/or polyethylenimine derivatives, including for example grafted PEIs such as galactose PEI, cholesterol PEI, antibody derivatized PEI, and polyethylene glycol PEI (PEG-PEI) derivatives thereof (see for example Ogris et al., 2001, AAPA PharmSci, 3, 1-11; Furgeson et al., 2003, Bioconjugate Chem., 14, 840-847; Kunath et al., 2002, Pharmaceutical Research, 19, 810-817; Choi et al., 2001, Bull. Korean Chem. Soc., 22, 46-52; Bettinger et al., 1999, Bioconjugate Chem., 10, 558-561; Peterson et al., 2002, Bioconjugate Chem., 13, 845-854; Erbacher et al., 1999, Journal of Gene Medicine Preprint, 1, 1-18; Godbey et al., 1999., PNAS USA, 96, 5177-5181; Godbey et al., 1999, Journal of Controlled Release, 60, 149-160; Diebold et al., 1999, Journal of Biological Chemistry, 274, 19087-19094; Thomas and Klibanov, 2002, PNAS USA, 99, 14640-14645; and Sagara, U.S. Pat. No. 6,586,524, incorporated by reference herein.

In one embodiment, an siNA molecule of the invention comprises a bioconjugate, for example a nucleic acid conjugate as described in Vargeese et al., U.S. Ser. No. 10/427,160, filed Apr. 30, 2003; U.S. Pat. Nos. 6,528,631; 6,335,434; 6,235,886; 6,153,737; 5,214,136; 5,138,045, all incorporated by reference herein.

Thus, the invention features a pharmaceutical composition comprising one or more nucleic acid(s) of the invention in an acceptable carrier, such as a stabilizer, buffer, and the like. The polynucleotides of the invention can be administered (e.g., RNA, DNA or protein) and introduced into a subject by any standard means, with or without stabilizers, buffers, and the like, to form a pharmaceutical composition. When it is desired to use a liposome delivery mechanism, standard protocols for formation of liposomes can be followed. The compositions of the present invention can also be formulated and used as tablets, capsules or elixirs for oral administration, suppositories for rectal administration, sterile solutions, suspensions for injectable administration, and the other compositions known in the art.

The present invention also includes pharmaceutically acceptable formulations of the compounds described. These formulations include salts of the above compounds, e.g., acid addition salts, for example, salts of hydrochloric, hydrobromic, acetic acid, and benzene sulfonic acid.

A pharmacological composition or formulation refers to a composition or formulation in a form suitable for administration, e.g., systemic administration, into a cell or subject, including for example a human. Suitable forms, in part, depend upon the use or the route of entry, for example oral, transdermal, or by injection. Such forms should not prevent the composition or formulation from reaching a target cell (i.e., a cell to which the negatively charged nucleic acid is desirable for delivery). For example, pharmacological compositions injected into the blood stream should be soluble. Other factors are known in the art, and include considerations such as toxicity and forms that prevent the composition or formulation from exerting its effect.

By "systemic administration" is meant in vivo systemic absorption or accumulation of drugs in the blood stream followed by distribution throughout the entire body. Administration routes that lead to systemic absorption include, without limitation: intravenous, subcutaneous, intraperitoneal, inhalation, oral, intrapulmonary and intramuscular. Each of these administration routes exposes the siNA molecules of the invention to an accessible diseased tissue. The rate of entry of a drug into the circulation has been shown to be a function of molecular weight or size. The use of a liposome or other drug carrier comprising the compounds of the instant invention can potentially localize the drug, for example, in certain tissue types, such as the tissues of the reticular endothelial system (RES). A liposome formulation that can facilitate the association of drug with the surface of cells, such as, lymphocytes and macrophages is also useful. This approach can provide enhanced delivery of the drug to target cells by taking advantage of the specificity of macrophage and lymphocyte immune recognition of abnormal cells, such as cancer cells.

By "pharmaceutically acceptable formulation" is meant a composition or formulation that allows for the effective distribution of the nucleic acid molecules of the instant invention in the physical location most suitable for their desired activity. Non-limiting examples of agents suitable for formulation with the nucleic acid molecules of the instant invention include: P-glycoprotein inhibitors (such as Pluronic P85), which can enhance entry of drugs into the CNS (Jolliet-Riant and Tillement, 1999, Fundam. Clin. Pharmacol., 13, 16-26); biodegradable polymers, such as poly (DL-lactide-coglycolide) microspheres for sustained release delivery after intracerebral implantation (Emerich, D F et al, 1999, Cell

*Transplant*, 8, 47-58) (Alkermes, Inc. Cambridge, Mass.); and loaded nanoparticles, such as those made of polybutylcyanoacrylate, which can deliver drugs across the blood brain barrier and can alter neuronal uptake mechanisms (*Prog Neuropsychopharmacol Biol Psychiatry*, 23, 941-949, 1999). Other non-limiting examples of delivery strategies for the nucleic acid molecules of the instant invention include material described in Boado et al., 1998, *J. Pharm. Sci.*, 87, 1308-1315; Tyler et al., 1999, *FEBS Lett.*, 421, 280-284; Pardridge et al., 1995, *PNAS USA.*, 92, 5592-5596; Boado, 1995, *Adv. Drug Delivery Rev.*, 15, 73-107; Aldrian-Herrada et al., 1998, *Nucleic Acids Res.*, 26, 4910-4916; and Tyler et al., 1999, *PNAS USA.*, 96, 7053-7058.

The invention also features the use of the composition comprising surface-modified liposomes containing poly (ethylene glycol) lipids (PEG-modified, or long-circulating liposomes or stealth liposomes). These formulations offer a method for increasing the accumulation of drugs in target tissues. This class of drug carriers resists opsonization and elimination by the mononuclear phagocytic system (MPS or RES), thereby enabling longer blood circulation times and enhanced tissue exposure for the encapsulated drug (Lasic et al. *Chem. Rev.* 1995, 95, 2601-2627; Ishiwata et al., *Chem. Pharm. Bull.* 1995, 43, 1005-1011). Such liposomes have been shown to accumulate selectively in tumors, presumably by extravasation and capture in the neovascularized target tissues (Lasic et al., *Science* 1995, 267, 1275-1276; Oku et al., 1995, *Biochim. Biophys. Acta*, 1238, 86-90). The long-circulating liposomes enhance the pharmacokinetics and pharmacodynamics of DNA and RNA, particularly compared to conventional cationic liposomes which are known to accumulate in tissues of the MPS (Liu et al., *J. Biol. Chem.* 1995, 42, 24864-24870; Choi et al., International PCT Publication No. WO 96/10391; Ansell et al., International PCT Publication No. WO 96/10390; Holland et al., International PCT Publication No. WO 96/10392). Long-circulating liposomes are also likely to protect drugs from nuclease degradation to a greater extent compared to cationic liposomes, based on their ability to avoid accumulation in metabolically aggressive MPS tissues such as the liver and spleen.

The present invention also includes compositions prepared for storage or administration that include a pharmaceutically effective amount of the desired compounds in a pharmaceutically acceptable carrier or diluent. Acceptable carriers or diluents for therapeutic use are well known in the pharmaceutical art, and are described, for example, in *Remington's Pharmaceutical Sciences*, Mack Publishing Co. (A. R. Gennaro edit. 1985), hereby incorporated by reference herein. For example, preservatives, stabilizers, dyes and flavoring agents can be provided. These include sodium benzoate, sorbic acid and esters of p-hydroxybenzoic acid. In addition, antioxidants and suspending agents can be used.

A pharmaceutically effective dose is that dose required to prevent, inhibit the occurrence, or treat (alleviate a symptom to some extent, preferably all of the symptoms) of a disease state. The pharmaceutically effective dose depends on the type of disease, the composition used, the route of administration, the type of mammal being treated, the physical characteristics of the specific mammal under consideration, concurrent medication, and other factors that those skilled in the medical arts will recognize. Generally, an amount between 0.1 mg/kg and 100 mg/kg body weight/day of active ingredients is administered dependent upon potency of the negatively charged polymer.

The nucleic acid molecules of the invention and formulations thereof can be administered orally, topically, parenterally, by inhalation or spray, or rectally in dosage unit formulations containing conventional non-toxic pharmaceutically acceptable carriers, adjuvants and/or vehicles. The term parenteral as used herein includes percutaneous, subcutaneous, intravascular (e.g., intravenous), intramuscular, or intrathecal injection or infusion techniques and the like. In addition, there is provided a pharmaceutical formulation comprising a nucleic acid molecule of the invention and a pharmaceutically acceptable carrier. One or more nucleic acid molecules of the invention can be present in association with one or more non-toxic pharmaceutically acceptable carriers and/or diluents and/or adjuvants, and if desired other active ingredients. The pharmaceutical compositions containing nucleic acid molecules of the invention can be in a form suitable for oral use, for example, as tablets, troches, lozenges, aqueous or oily suspensions, dispersible powders or granules, emulsion, hard or soft capsules, or syrups or elixirs.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate, or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Dispersible powders and granules suitable for preparation of an aqueous suspension by the addition of water provide the active ingredient in admixture with a dispersing or wetting agent, suspending agent and one or more preservatives. Suitable dispersing or wetting agents or suspending agents are exemplified by those already mentioned above. Additional excipients, for example sweetening, flavoring and coloring agents, can also be present.

Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

Dosage levels of the order of from about 0.1 mg to about 140 mg per kilogram of body weight per day are useful in the treatment of the above-indicated conditions (about 0.5 mg to about 7 g per subject per day). The amount of active ingredient that can be combined with the carrier materials to produce a single dosage form varies depending upon the host treated and the particular mode of administration. Dosage unit forms generally contain between from about 1 mg to about 500 mg of an active ingredient.

It is understood that the specific dose level for any particular subject depends upon a variety of factors including the activity of the specific compound employed, the age, body weight, general health, sex, diet, time of administration, route of administration, and rate of excretion, drug combination and the severity of the particular disease undergoing therapy.

For administration to non-human animals, the composition can also be added to the animal feed or drinking water. It can be convenient to formulate the animal feed and drinking water compositions so that the animal takes in a therapeutically appropriate quantity of the composition along with its diet. It can also be convenient to present the composition as a premix for addition to the feed or drinking water.

The nucleic acid molecules of the present invention can also be administered to a subject in combination with other therapeutic compounds to increase the overall therapeutic effect. The use of multiple compounds to treat an indication can increase the beneficial effects while reducing the presence of side effects.

In one embodiment, the invention comprises compositions suitable for administering nucleic acid molecules of the invention to specific cell types. For example, the asialoglycoprotein receptor (ASGPr) (Wu and Wu, 1987, *J. Biol. Chem.* 262, 4429-4432) is unique to hepatocytes and binds branched galactose-terminal glycoproteins, such as asialoorosomucoid (ASOR). In another example, the folate receptor is overexpressed in many cancer cells. Binding of such glycoproteins, synthetic glycoconjugates, or folates to the receptor takes place with an affinity that strongly depends on the degree of branching of the oligosaccharide chain, for example, triatennary structures are bound with greater affinity than biatennary or monoatennary chains (Baenziger and Fiete, 1980, *Cell*, 22, 611-620; Connolly et al., 1982, *J. Biol. Chem.*, 257, 939-945). Lee and Lee, 1987, *Glycoconjugate J.*, 4, 317-328, obtained this high specificity through the use of N-acetyl-D-galactosamine as the carbohydrate moiety, which has higher affinity for the receptor, compared to galactose. This "clustering effect" has also been described for the binding and uptake of mannosyl-terminating glycoproteins or glycoconjugates (Ponpipom et al., 1981, *J. Med. Chem.*, 24, 1388-1395). The use of galactose, galactosamine, or folate based conjugates to transport exogenous compounds across cell membranes can provide a targeted delivery approach to, for example, the treatment of liver disease, cancers of the liver, or other cancers. The use of bioconjugates can also provide a reduction in the required dose of therapeutic compounds required for treatment. Furthermore, therapeutic bioavailability, pharmacodynamics, and pharmacokinetic parameters can be modulated through the use of nucleic acid bioconjugates of the invention. Non-limiting examples of such bioconjugates are described in Vargeese et al., U.S. Ser. No. 10/201,394, filed Aug. 13, 2001; and Matulic-Adamic et al., U.S. Ser. No. 10/151,116, filed May 17, 2002. In one embodiment, nucleic acid molecules of the invention are complexed with or covalently attached to nanoparticles, such as Hepatitis B virus S, M, or L evelope proteins (see for example Yamado et al., 2003, *Nature Biotechnology*, 21, 885). In one embodiment, nucleic acid molecules of the invention are delivered with specificity for human tumor cells, specifically non-apoptotic human tumor cells including for example T-cells, hepatocytes, breast carcinoma cells, ovarian carcinoma cells, melanoma cells, intestinal epithelial cells, prostate cells, testicular cells, non-small cell lung cancers, small cell lung cancers, etc.

In one embodiment, an siNA molecule of the invention is designed or formulated to specifically target endothelial cells or tumor cells. For example, various formulations and conjugates can be utilized to specifically target endothelial cells or tumor cells, including PEI-PEG-folate, PEI-PEG-RGD, PEI-PEG-biotin, PEI-PEG-cholesterol, and other conjugates known in the art that enable specific targeting to endothelial cells and/or tumor cells.

Alternatively, certain siNA molecules of the instant invention can be expressed within cells from eukaryotic promoters (e.g., Izant and Weintraub, 1985, Science, 229, 345; McGarry and Lindquist, 1986, Proc. Natl. Acad. Sci., USA 83, 399; Scanlon et al., 1991, Proc. Natl. Acad. Sci. USA, 88, 10591-5; Kashani-Sabet et al., 1992, Antisense Res. Dev., 2, 3-15; propulic et al., 1992, J. Virol., 66, 1432-41; Weerasinghe et al., 1991, J. Virol., 65, 5531-4; Ojwang et al., 1992, Proc. Natl. Acad. Sci. USA, 89, 10802-6; Chen et al., 1992, Nucleic Acids Res., 20, 4581-9; Sarver et al., 1990 Science, 247, 1222-1225; Thompson et al., 1995, Nucleic Acids Res., 23, 2259; Good et al., 1997, Gene Therapy, 4, 45). Those skilled in the art realize that any nucleic acid can be expressed in eukaryotic cells from the appropriate DNA/RNA vector. The activity of such nucleic acids can be augmented by their release from the primary transcript by a enzymatic nucleic acid (Draper et al., PCT WO 93/23569, and Sullivan et al., PCT WO 94/02595; Ohkawa et al., 1992, Nucleic Acids Symp. Ser., 27, 15-6; Taira et al., 1991, Nucleic Acids Res., 19, 5125-30; Ventura et al., 1993, Nucleic Acids Res., 21, 3249-55; Chowrira et al., 1994, J. Biol. Chem., 269, 25856).

In another aspect of the invention, RNA molecules of the present invention can be expressed from transcription units (see for example Couture et al., 1996, TIG., 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus. In another embodiment, pol III based constructs are used to express nucleic acid molecules of the invention (see for example Thompson, U.S. Pats. Nos. 5,902,880 and 6,146,886). The recombinant vectors capable of expressing the siNA molecules can be delivered as described above, and persist in target cells. Alternatively, viral vectors can be used that provide for transient expression of nucleic acid molecules. Such vectors can be repeatedly administered as necessary. Once expressed, the siNA molecule interacts with the target mRNA and generates an RNAi response. Delivery of siNA molecule expressing vectors can be systemic, such as by intravenous or intramuscular administration, by administration to target cells ex-planted from a subject followed by reintroduction into the subject, or by any other means that would allow for introduction into the desired target cell (for a review see Couture et al., 1996, TIG., 12, 510).

In one aspect the invention features an expression vector comprising a nucleic acid sequence encoding at least one siNA molecule of the instant invention. The expression vector can encode one or both strands of an siNA duplex, or a single self-complementary strand that self hybridizes into an siNA duplex. The nucleic acid sequences encoding the siNA molecules of the instant invention can be operably linked in a manner that allows expression of the siNA molecule (see for example Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi: 10.1038/nm725).

In another aspect, the invention features an expression vector comprising: a) a transcription initiation region (e.g., eukaryotic pol I, II or III initiation region); b) a transcription termination region (e.g., eukaryotic pol I, II or III termination region); and c) a nucleic acid sequence encoding at least one of the siNA molecules of the instant invention, wherein said sequence is operably linked to said initiation region and said termination region in a manner that allows expression and/or delivery of the siNA molecule. The vector can optionally include an open reading frame (ORF) for a protein operably linked on the 5' side or the 3'-side of the sequence encoding the siNA of the invention; and/or an intron (intervening sequences).

Transcription of the siNA molecule sequences can be driven from a promoter for eukaryotic RNA polymerase I (pol I), RNA polymerase II (pol II), or RNA polymerase III (pol III). Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, Proc. Natl. Acad. Sci. U S A, 87, 6743-7; Gao and Huang 1993, Nucleic Acids Res., 21, 2867-72; Lieber et al., 1993, Methods Enzymol., 217, 47-66; Zhou et al., 1990, Mol. Cell. Biol., 10, 4529-37). Several investigators have demonstrated that nucleic acid molecules expressed from such promoters can function in mammalian cells (e.g. Kashani-Sabet et al., 1992, Antisense Res. Dev., 2, 3-15; Ojwang et al., 1992, Proc. Natl. Acad. Sci. USA, 89, 10802-6; Chen et al., 1992, Nucleic Acids Res., 20, 4581-9; Yu et al., 1993, Proc. Natl. Acad. Sci. USA, 90, 6340-4; L'Huillier et al., 1992, EMBO J., 11, 4411-8; Lisziewicz et al., 1993, Proc. Natl. Acad. Sci. U. S. A, 90, 8000-4; Thompson et al., 1995, Nucleic Acids Res., 23, 2259; Sullenger & Cech, 1993, Science, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, Nucleic Acid Res., 22, 2830; Noonberg et al., U.S. Pat. No. 5,624,803; Good et al., 1997, Gene Ther., 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

In another aspect the invention features an expression vector comprising a nucleic acid sequence encoding at least one of the siNA molecules of the invention in a manner that allows expression of that siNA molecule. The expression vector comprises in one embodiment; a) a transcription initiation region; b) a transcription termination region; and c) a nucleic acid sequence encoding at least one strand of the siNA molecule, wherein the sequence is operably linked to the initiation region and the termination region in a manner that allows expression and/or delivery of the siNA molecule.

In another embodiment the expression vector comprises: a) a transcription initiation region; b) a transcription termination region; c) an open reading frame; and d) a nucleic acid sequence encoding at least one strand of an siNA molecule, wherein the sequence is operably linked to the 3'-end of the open reading frame and wherein the sequence is operably linked to the initiation region, the open reading frame and the termination region in a manner that allows expression and/or delivery of the siNA molecule. In yet another embodiment, the expression vector comprises: a) a transcription initiation region; b) a transcription termination region; c) an intron; and d) a nucleic acid sequence encoding at least one siNA molecule, wherein the sequence is operably linked to the initiation region, the intron and the termination region in a manner which allows expression and/or delivery of the nucleic acid molecule.

In another embodiment, the expression vector comprises: a) a transcription initiation region; b) a transcription termination region; c) an intron; d) an open reading frame; and e) a nucleic acid sequence encoding at least one strand of an siNA molecule, wherein the sequence is operably linked to the 3'-end of the open reading frame and wherein the sequence is operably linked to the initiation region, the intron, the open reading frame and the termination region in a manner which allows expression and/or delivery of the siNA molecule.

Interleukin Biology and Biochemistry

The following discussion is adapted from R&D Systems Mini-Reviews and Tech Notes, Cytokine Mini-Reviews, Copyright©2002 R&D Systems. Interleukin 2 (IL-2) is a lymphokine synthesized and secreted primarily by T helper lymphocytes that have been activated by stimulation with certain mitogens or by interaction of the T cell receptor complex with antigen/MHC complexes on the surfaces of antigen-presenting cells. The response of T helper cells to activation is induction of the expression of IL-2 and receptors for IL-2 and, subsequently, clonal expansion of antigen-specific T cells. At this level IL-2 is an autocrine factor, driving the expansion of the antigen-specific cells. IL-2 also acts as a paracrine factor, influencing the activity of other cells, both within the immune system and outside of it. B cells and natural killer (NK) cells respond, when properly activated, to IL-2. The so-called lymphocyte activated killer, or LAK cells, appear to be derived from NK cells under the influence of IL-2.

The biological activities of IL-2 are mediated through the binding of IL-2 to a multisubunit cellular receptor. Although three distinct transmembrane glycoprotein subunits contribute to the formation of the high affinity IL-2 receptor, various combinations of receptor subunits (alpha, beta, gamma) are known to occur.

Interleukin 1 (IL-1) is a general name for two distinct proteins, IL-1a and IL-1b, that are considered the first of a family of regulatory and inflammatory cytokines. Along with IL-1 receptor antagonist (IL-1ra)2 and IL-18,3 these molecules play important roles in the up- and down-regulation of acute inflammation. In the immune system, the production of IL-1 is typically induced, generally resulting in inflammation. IL-1b and TNF-a are generally thought of as prototypical pro-inflammatory cytokines. The effects of IL-1, however, are not limited to inflammation, as IL-1 has also been associated with bone formation and remodeling, insulin secretion, appetite regulation, fever induction, neuronal phenotype development, and IGF/GH physiology. IL-1 has also been known by a number of alternative names, including lymphocyte activating factor, endogenous pyrogen, catabolin, hemopoietin-1, melanoma growth inhibition factor, and osteoclast activating factor. IL-1a and IL-1b exert their effects by binding to specific receptors. Two distinct IL-1 receptor binding proteins, plus a non-binding signaling accessory protein have been identified to date. Each have three extracellular immunoglobulin-like (Ig-like) domains, qualifying them for membership in the type IV cytokine receptor family.

Interleukin-4 (IL-4) mediates important pro-inflammatory functions in asthma including induction of the IgE isotype switch, expression of vascular cell adhesion molecule-1 (VCAM-1), promotion of eosinophil transmigration across endothelium, mucus secretion, and differentiation of T helper type 2 lymphocytes leading to cytokine release. Asthma has been linked to polymorphisms in the IL-4 gene promoter and proteins involved in IL-4 signaling. Soluble recombinant IL-4 receptor lacks transmembrane and cytoplasmic activating domains and can therefore sequester IL-4 without mediating cellular activation. Genetic variants within the IL-4 signaling pathway might contribute to the risk of developing asthma in a given individual. A number of polymorphisms have been described within the IL-4 receptor a (IL-4Rα) gene, and in addition, polymorphism occurs in the promoter for the IL-4 gene itself (see for example Hall, 2000, *Respir. Res.*, 1, 6-8 and Ober et al., 2000, *Am J Hum Genet.*, 66, 517-526, for a review). The type 2 cytokine IL-13, which shares a receptor component and signaling pathways with IL-4, was found to be necessary and sufficient for the expression of allergic asthma (see Wills-Karp et al., 1998, *Science*, 282, 2258-61). IL-13 induces the pathophysiological features of asthma in a manner that is independent of immunoglobulin E and eosinophils. Thus, IL-13 is critical to allergen-induced asthma but operates through mechanisms other than those that are classically implicated in allergic responses.

Human IL-5 is a 134 amino acid polypeptide with a predicted mass of 12.5 kDa. It is secreted by a restricted number of mesenchymal cell types. In its native state, mature IL-5 is synthesized as a 115 aa, highly glycosylated 22 kDa monomer that forms a 40-50 kDa disulfide-linked homodimer. Although the content of carbohydrate is high, carbohydrate is not needed for bioactivity. Monomeric IL-5 has no activity; a homodimer is required for function. This is in contrast to the receptor-related cytokines IL-3 and GM-CSF, which exist only as monomers. Just as one IL-3 and GM-CSF monomer binds to one receptor, one IL-5 homodimer is able to engage only one IL-5 receptor. It has been suggested that IL-5 (as a dimer) undergoes a general conformational change after binding to one receptor molecule, and this change precludes binding to a second receptor. The receptor for IL-5 consists of a ligand binding a-subunit and a non-ligand binding (common) signal transducing b-subunit that is shared by the receptors for IL-3 and GM-CSF. IL-5 appears to perform a number of functions on eosinophils. These include the down modulation of Mac-1, the upregulation of receptors for IgA and IgG, the stimulation of lipid mediator (leukotriene C4 and PAF) secretion and the induction of granule release. IL-5 also promotes the growth and differentiation of eosinophils.

Interleukin 6 (IL-6) is considered a prototypic pleiotrophic cytokine. This is reflected in the variety of names originally assigned to IL-6 based on function, including Interferon b2, IL-1-inducible 26 kD Protein, Hepatocyte Stimulating Factor, Cytotoxic T-cell Differentiation Factor, B cell Differentiation Factor (BCDF) and/or B cell Stimulatory Factor 2 (BSF2). A number of cytokines make up an IL-6 cytokine family. Membership in this family is typically based on a helical cytokine structure and receptor subunit makeup. The functional receptor for IL-6 is a complex of two transmembrane glycoproteins (gp130 and IL-6 receptor) that are members of the Class I cytokine receptor superfamily.

Because of the central role of the interleukin family of cytokines in the mediation of immune and inflammatory responses, modulation of interleukin expression and/or activity can provide important functions in therapeutic and diagnostic applications. The use of small interfering nucleic acid molecules targeting interleukins and their corresponding receptors therefore provides a class of novel therapeutic agents that can be used in the treatment of cancers, proliferative diseases, inflammatory disease, respiratory disease, pulmonary disease, cardiovascular disease, autoimmune disease, infectious disease, prior disease, renal disease, transplant rejection, or any other disease or condition that responds to modulation of interleukin and interleukin receptor genes.

EXAMPLES

The following are non-limiting examples showing the selection, isolation, synthesis and activity of nucleic acids of the instant invention.

Example 1

Tandem Synthesis of siNA Constructs

Exemplary siNA molecules of the invention are synthesized in tandem using a cleavable linker, for example, a succinyl-based linker. Tandem synthesis as described herein is followed by a one-step purification process that provides RNAi molecules in high yield. This approach is highly amenable to siNA synthesis in support of high throughput RNAi screening, and can be readily adapted to multi-column or multi-well synthesis platforms.

After completing a tandem synthesis of an siNA oligo and its complement in which the 5'-terminal dimethoxytrityl (5'-O-DMT) group remains intact (trityl on synthesis), the oligonucleotides are deprotected as described above. Following deprotection, the siNA sequence strands are allowed to spontaneously hybridize. This hybridization yields a duplex in which one strand has retained the 5'-O-DMT group while the complementary strand comprises a terminal 5'-hydroxyl. The newly formed duplex behaves as a single molecule during routine solid-phase extraction purification (Trityl-On purification) even though only one molecule has a dimethoxytrityl group. Because the strands form a stable duplex, this dimethoxytrityl group (or an equivalent group, such as other trityl groups or other hydrophobic moieties) is all that is required to purify the pair of oligos, for example, by using a C18 cartridge.

Standard phosphoramidite synthesis chemistry is used up to the point of introducing a tandem linker, such as an inverted deoxy abasic succinate or glyceryl succinate linker (see FIG. 1) or an equivalent cleavable linker. A non-limiting example of linker coupling conditions that can be used includes a hindered base such as diisopropylethylamine (DIPA) and/or DMAP in the presence of an activator reagent such as Bromotripyrrolidinophosphoniumhexafluororophosphate (PyBrOP). After the linker is coupled, standard synthesis chemistry is utilized to complete synthesis of the second sequence leaving the terminal the 5'-O-DMT intact. Following synthesis, the resulting oligonucleotide is deprotected according to the procedures described herein and quenched with a suitable buffer, for example with 50 mM NaOAc or 1.5M $NH_4H_2CO_3$.

Purification of the siNA duplex can be readily accomplished using solid phase extraction, for example using a Waters C18 SepPak 1 g cartridge conditioned with 1 column volume (CV) of acetonitrile, 2 CV H2O, and 2 CV 50 mM NaOAc. The sample is loaded and then washed with 1 CV H2O or 50 mM NaOAc. Failure sequences are eluted with 1 CV 14% ACN (Aqueous with 50 mM NaOAc and 50 mM NaCl). The column is then washed, for example with 1 CV H2O followed by on-column detritylation, for example by passing 1 CV of 1% aqueous trifluoroacetic acid (TFA) over the column, then adding a second CV of 1% aqueous TFA to the column and allowing to stand for approximately 10 minutes. The remaining TFA solution is removed and the column washed with H20 followed by 1 CV 1M NaCl and additional H2O. The siNA duplex product is then eluted, for example, using 1 CV 20% aqueous CAN.

FIG. 2 provides an example of MALDI-TOF mass spectrometry analysis of a purified siNA construct in which each peak corresponds to the calculated mass of an individual siNA strand of the siNA duplex. The same purified siNA provides three peaks when analyzed by capillary gel electrophoresis (CGE), one peak presumably corresponding to the duplex siNA, and two peaks presumably corresponding to the separate siNA sequence strands. Ion exchange HPLC analysis of the same siNA contract only shows a single peak. Testing of the purified siNA construct using a luciferase reporter assay described below demonstrated the same RNAi activity compared to siNA constructs generated from separately synthesized oligonucleotide sequence strands.

Example 2

Identification of Potential siNA Target Sites in any RNA Sequence

The sequence of an RNA target of interest, such as a viral or human mRNA transcript, is screened for target sites, for example by using a computer folding algorithm. In a non-limiting example, the sequence of a gene or RNA gene transcript derived from a database, such as Genbank, is used to generate siNA targets having complementarity to the target. Such sequences can be obtained from a database, or can be determined experimentally as known in the art. Target sites that are known, for example, those target sites determined to be effective target sites based on studies with other nucleic acid molecules, for example ribozymes or antisense, or those targets known to be associated with a disease or condition such as those sites containing mutations or deletions, can be used to design siNA molecules targeting those sites. Various parameters can be used to determine which sites are the most suitable target sites within the target RNA sequence. These parameters include but are not limited to secondary or tertiary RNA structure, the nucleotide base composition of the target sequence, the degree of homology between various regions of the target sequence, or the relative position of the target sequence within the RNA transcript. Based on these determinations, any number of target sites within the RNA transcript can be chosen to screen siNA molecules for efficacy, for example by using in vitro RNA cleavage assays, cell culture, or animal models. In a non-limiting example, anywhere from 1 to 1000 target sites are chosen within the transcript based on the size of the siNA construct to be used. High throughput screening assays can be developed for screening siNA molecules using methods known in the art, such as with multi-well or multi-plate assays to determine efficient reduction in target gene expression.

Example 3

Selection of siNA Molecule Target Fites in a RNA

The following non-limiting steps can be used to carry out the selection of siNAs targeting a given gene sequence or transcript.

1. The target sequence is parsed in silico into a list of all fragments or subsequences of a particular length, for example 23 nucleotide fragments, contained within the target sequence. This step is typically carried out using a custom Perl script, but commercial sequence analysis programs such as Oligo, MacVector, or the GCG Wisconsin Package can be employed as well.

2. In some instances the siNAs correspond to more than one target sequence; such would be the case for example in targeting different transcripts of the same gene, targeting different transcripts of more than one gene, or for targeting both the human gene and an animal homolog. In this case, a subsequence list of a particular length is generated for each of the targets, and then the lists are compared to find matching sequences in each list. The subsequences are then ranked according to the number of target sequences that contain the given subsequence; the goal is to find subsequences that are present in most or all of the target sequences. Alternately, the ranking can identify subsequences that are unique to a target sequence, such as a mutant target sequence. Such an approach would enable the use of siNA to target specifically the mutant sequence and not effect the expression of the normal sequence.

3. In some instances the siNA subsequences are absent in one or more sequences while present in the desired target sequence; such would be the case if the siNA targets a gene with a paralogous family member that is to remain untargeted. As in case 2 above, a subsequence list of a particular length is generated for each of the targets, and then the lists are compared to find sequences that are present in the target gene but are absent in the untargeted paralog.

4. The ranked siNA subsequences can be further analyzed and ranked according to GC content. A preference can be given to sites containing 30-70% GC, with a further preference to sites containing 40-60% GC.

5. The ranked siNA subsequences can be further analyzed and ranked according to self-folding and internal hairpins. Weaker internal folds are preferred; strong hairpin structures are to be avoided.

6. The ranked siNA subsequences can be further analyzed and ranked according to whether they have runs of GGG or CCC in the sequence. GGG (or even more Gs) in either strand can make oligonucleotide synthesis problematic and can potentially interfere with RNAi activity, so it is avoided whenever better sequences are available. CCC is searched in the target strand because that will place GGG in the antisense strand.

7. The ranked siNA subsequences can be further analyzed and ranked according to whether they have the dinucleotide UU (uridine dinucleotide) on the 3'-end of the sequence, and/or AA on the 5'-end of the sequence (to yield 3' UU on the antisense sequence). These sequences allow one to design siNA molecules with terminal TT thymidine dinucleotides.

8. Four or five target sites are chosen from the ranked list of subsequences as described above. For example, in subsequences having 23 nucleotides, the right 21 nucleotides of each chosen 23-mer subsequence are then designed and synthesized for the upper (sense) strand of the siNA duplex, while the reverse complement of the left 21 nucleotides of each chosen 23-mer subsequence are then designed and synthesized for the lower (antisense) strand of the siNA duplex (see Tables II and III). If terminal TT residues are desired for the sequence (as described in paragraph 7), then the two 3' terminal nucleotides of both the sense and antisense strands are replaced by TT prior to synthesizing the oligos.

9. The siNA molecules are screened in an in vitro, cell culture or animal model system to identify the most active siNA molecule or the most preferred target site within the target RNA sequence.

10. Other design considerations can be used when selecting target nucleic acid sequences, see for example Reynolds et al., 2004, *Nature Biotechnology Advanced Online Publication*, 1 Feb. 2004, doi:10.1038/nbt936 and Ui-Tei et al., 2004, Nucleic Acids Research, 32, doi:10.1093/nar/gkh247.

Figure 7:
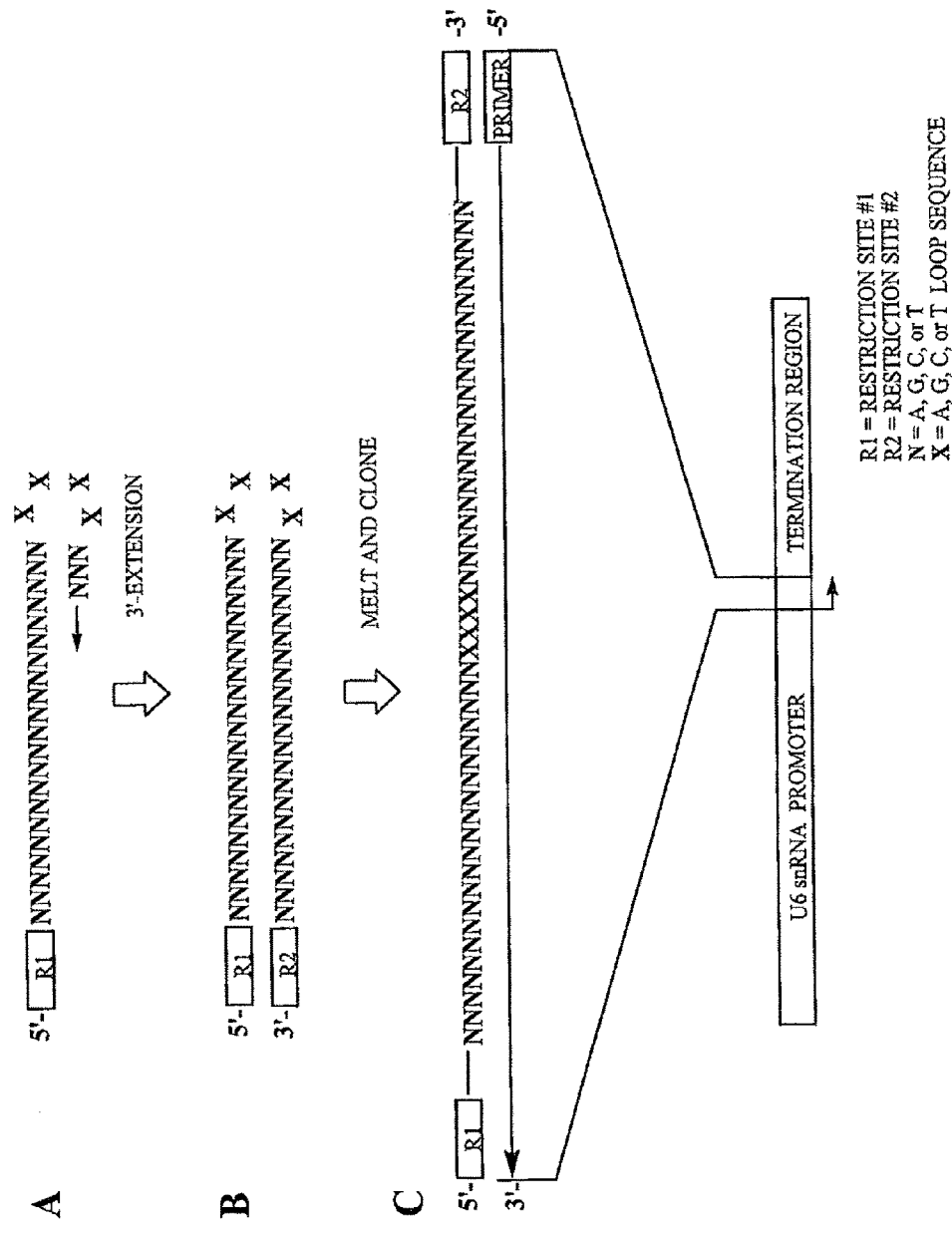
FIG. 7A-C is a diagrammatic representation of a scheme utilized in generating an expression cassette to generate siNA hairpin constructs.
Figure 8:
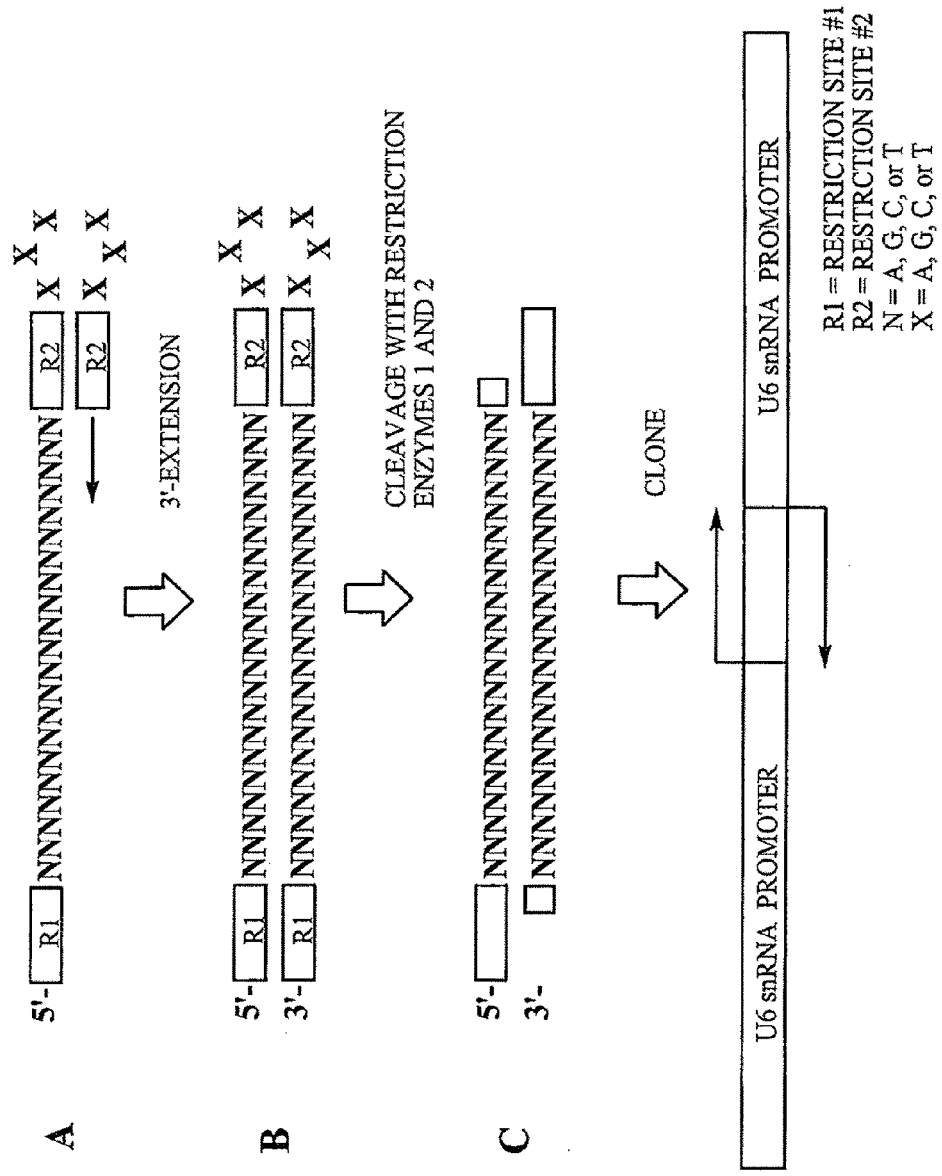
FIG. 8A-C is a diagrammatic representation of a scheme utilized in generating an expression cassette to generate double-stranded siNA constructs.
Figure 9:
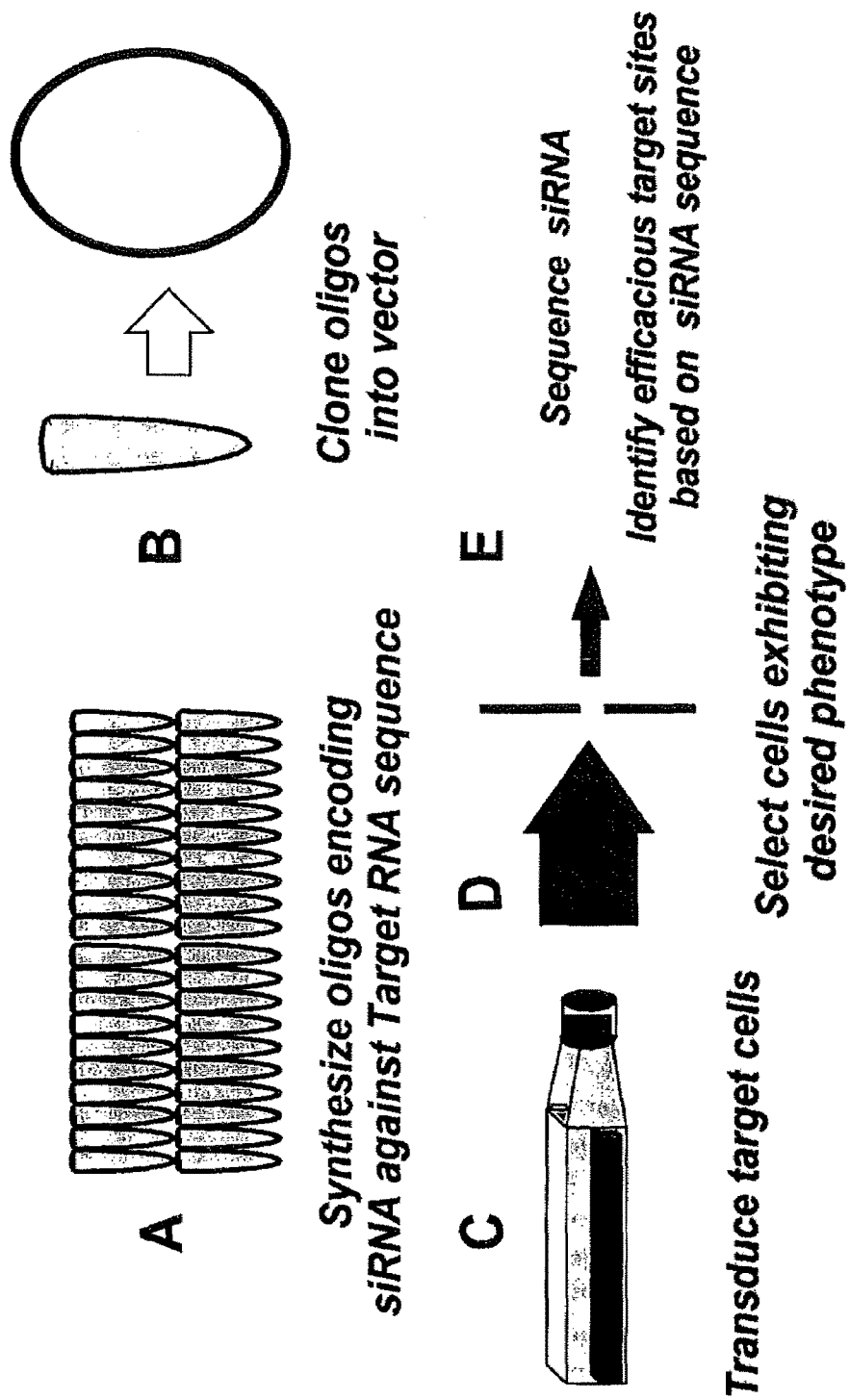
FIG. 9A-E is a diagrammatic representation of a method used to determine target sites for siNA mediated RNAi within a particular target nucleic acid sequence, such as messenger RNA.

In an alternate approach, a pool of siNA constructs specific to a interleukin and/or interleukin receptor target sequence is used to screen for target sites in cells expressing interleukin and/or interleukin receptor RNA, such as cultured Jurkat, HeLa, or 293T cells. The general strategy used in this approach is shown in FIG. 9. A non-limiting example of such is a pool comprising sequences having any of SEQ ID NOS 1-1828. Cells expressing interleukin and/or interleukin receptor (e.g., Jurkat, HeLa, or 293T cells) are transfected with the pool of siNA constructs and cells that demonstrate a phenotype associated with interleukin and/or interleukin receptor inhibition are sorted. The pool of siNA constructs can be expressed from transcription cassettes inserted into appropriate vectors (see for example FIG. 7 and FIG. 8). The siNA from cells demonstrating a positive phenotypic change (e.g., decreased interleukin and/or interleukin receptor mRNA levels or decreased interleukin and/or interleukin receptor protein expression), are sequenced to determine the most suitable target site(s) within the target interleukin and/or interleukin receptor RNA sequence.

Example 4

Interleukin and Interleukin Receptor Targeted siNA Design siNA target sites were chosen by analyzing sequences of the interleukin and/or interleukin receptor RNA target and optionally prioritizing the target sites on the basis of folding (structure of any given sequence analyzed to determine siNA accessibility to the target), by using a library of siNA molecules as described in Example 3, or alternately by using an in vitro siNA system as described in Example 6 herein. siNA molecules were designed that could bind each target and are optionally individually analyzed by computer folding to assess whether the siNA molecule can interact with the target sequence. Varying the length of the siNA molecules can be chosen to optimize activity. Generally, a sufficient number of complementary nucleotide bases are chosen to bind to, or otherwise interact with, the target RNA, but the degree of complementarity can be modulated to accommodate siNA duplexes or varying length or base composition. By using such methodologies, siNA molecules can be designed to target sites within any known RNA sequence, for example those RNA sequences corresponding to the any gene transcript.

Chemically modified siNA constructs are designed to provide nuclease stability for systemic administration in vivo and/or improved pharmacokinetic, localization, and delivery properties while preserving the ability to mediate RNAi activity. Chemical modifications as described herein are introduced synthetically using synthetic methods described herein and those generally known in the art. The synthetic siNA constructs are then assayed for nuclease stability in serum and/or cellular/tissue extracts (e.g. liver extracts). The synthetic siNA constructs are also tested in parallel for RNAi activity using an appropriate assay, such as a luciferase reporter assay as described herein or another suitable assay that can quantity RNAi activity. Synthetic siNA constructs that possess both nuclease stability and RNAi activity can be further modified and re-evaluated in stability and activity assays. The chemical modifications of the stabilized active siNA constructs can then be applied to any siNA sequence targeting any chosen RNA and used, for example, in target screening assays to pick lead siNA compounds for therapeutic development (see for example FIG. 11).

Example 5

Chemical Synthesis and Purification of siNA siNA molecules can be designed to interact with various sites in the RNA message, for example, target sequences within the RNA sequences described herein. The sequence of one strand of the siNA molecule(s) is complementary to the target site sequences described above. The siNA molecules can be chemically synthesized using methods described herein. Inactive siNA molecules that are used as control sequences can be synthesized by scrambling the sequence of the siNA molecules such that it is not complementary to the target sequence. Generally, siNA constructs can by synthesized using solid phase oligonucleotide synthesis methods as described herein (see for example Usman et al., U.S. Pat. Nos. 5,804,683; 5,831,071; 5,998,203; 6,117,657; 6,353,098; 6,362,323; 6,437,117; 6,469,158; Scaringe et al., U.S. Pat. Nos. 6,111,086; 6,008,400; 6,111,086 all incorporated by reference herein in their entirety).

In a non-limiting example, RNA oligonucleotides are synthesized in a stepwise fashion using the phosphoramidite chemistry as is known in the art. Standard phosphoramidite chemistry involves the use of nucleosides comprising any of 5'-O-dimethoxytrityl, 2'-O-tert-butyldimethylsilyl, 3'-O-2-Cyanoethyl N,N-diisopropylphos-phoroamidite groups, and exocyclic amine protecting groups (e.g. N6-benzoyl adenosine, N4 acetyl cytidine, and N2-isobutyryl guanosine). Alternately, 2'-O-Silyl Ethers can be used in conjunction with acid-labile 2'-O-orthoester protecting groups in the synthesis of RNA as described by Scaringe supra. Differing 2' chemistries can require different protecting groups, for example 2'-deoxy-2'-amino nucleosides can utilize N-phthaloyl protection as described by Usman et al., U.S. Pat. No. 5,631,360, incorporated by reference herein in its entirety).

During solid phase synthesis, each nucleotide is added sequentially (3'- to 5'-direction) to the solid support-bound oligonucleotide. The first nucleoside at the 3'-end of the chain is covalently attached to a solid support (e.g., controlled pore glass or polystyrene) using various linkers. The nucleotide precursor, a ribonucleoside phosphoramidite, and activator are combined resulting in the coupling of the second nucleoside phosphoramidite onto the 5'-end of the first nucleoside. The support is then washed and any unreacted 5'-hydroxyl groups are capped with a capping reagent such as acetic anhydride to yield inactive 5'-acetyl moieties. The trivalent phosphorus linkage is then oxidized to a more stable phosphate linkage. At the end of the nucleotide addition cycle, the 5'-O-protecting group is cleaved under suitable conditions (e.g., acidic conditions for trityl-based groups and Fluoride for silyl-based groups). The cycle is repeated for each subsequent nucleotide.

Modification of synthesis conditions can be used to optimize coupling efficiency, for example by using differing coupling times, differing reagent/phosphoramidite concentrations, differing contact times, differing solid supports and solid support linker chemistries depending on the particular chemical composition of the siNA to be synthesized. Deprotection and purification of the siNA can be performed as is generally described in Usman et al., U.S. Pat. Nos. 5,831,071, 6,353,098, 6,437,117, and Bellon et al., U.S. Pat. Nos. 6,054,576, 6,162,909, 6,303,773, or Scaringe supra, incorporated by reference herein in their entireties. Additionally, deprotection conditions can be modified to provide the best possible yield and purity of siNA constructs. For example, applicant has observed that oligonucleotides comprising 2'-deoxy-2'-fluoro nucleotides can degrade under inappropriate deprotection conditions. Such oligonucleotides are deprotected using aqueous methylamine at about 35° C. for 30 minutes. If the 2'-deoxy-2'-fluoro containing oligonucleotide also comprises ribonucleotides, after deprotection with aqueous methylamine at about 35° C. for 30 minutes, TEA-HF is added and the reaction maintained at about 65° C. for an additional 15 minutes.

Example 6

RNAi In Vitro Assay to Assess siNA Activity

An in vitro assay that recapitulates RNAi in a cell-free system is used to evaluate siNA constructs targeting interleukin and/or interleukin receptor RNA targets. The assay comprises the system described by Tuschl et al., 1999, *Genes and Development*, 13, 3191-3197 and Zamore et al., 2000, *Cell*, 101, 25-33 adapted for use with interleukin and/or interleukin receptor target RNA. A *Drosophila* extract derived from syncytial blastoderm is used to reconstitute RNAi activity in vitro. Target RNA is generated via in vitro transcription from an appropriate interleukin and/or interleukin receptor expressing plasmid using T7 RNA polymerase or via chemical synthesis as described herein. Sense and antisense siNA strands (for example 20 uM each) are annealed by incubation in buffer (such as 100 mM potassium acetate, 30 mM HEPES-KOH, pH 7.4, 2 mM magnesium acetate) for 1 minute at 90° C. followed by 1 hour at 37° C., then diluted in lysis buffer (for example 100 mM potassium acetate, 30 mM HEPES-KOH at pH 7.4, 2 mM magnesium acetate). Annealing can be monitored by gel electrophoresis on an agarose gel in TBE buffer and stained with ethidium bromide. The *Drosophila* lysate is prepared using zero to two-hour-old embryos from Oregon R flies collected on yeasted molasses agar that are dechorionated and lysed. The lysate is centrifuged and the supernatant isolated. The assay comprises a reaction mixture containing 50% lysate [vol/vol], RNA (10-50 pM final concentration), and 10% [vol/vol] lysis buffer containing siNA (10 nM final concentration). The reaction mixture also contains 10 mM creatine phosphate, 10 ug/ml creatine phosphokinase, 100 um GTP, 100 uM UTP, 100 uM CTP, 500 uM ATP, 5 mM DTT, 0.1 U/uL RNasin (Promega), and 100 uM of each amino acid. The final concentration of potassium acetate is adjusted to 100 mM. The reactions are pre-assembled on ice and preincubated at 25° C. for 10 minutes before adding RNA, then incubated at 25° C. for an additional 60 minutes. Reactions are quenched with 4 volumes of 1.25× Passive Lysis Buffer (Promega). Target RNA cleavage is assayed by RT-PCR analysis or other methods known in the art and are compared to control reactions in which siNA is omitted from the reaction.

Alternately, internally-labeled target RNA for the assay is prepared by in vitro transcription in the presence of [alpha-$^{32}$P] CTP, passed over a G 50 Sephadex column by spin chromatography and used as target RNA without further purification. Optionally, target RNA is 5'-$^{32}$P-end labeled using T4 polynucleotide kinase enzyme. Assays are performed as described above and target RNA and the specific RNA cleavage products generated by RNAi are visualized on an autoradiograph of a gel. The percentage of cleavage is determined by PHOSPHOR IMAGER® (autoradiography) quantitation of bands representing intact control RNA or RNA from control reactions without siNA and the cleavage products generated by the assay.

In one embodiment, this assay is used to determine target sites the interleukin and/or interleukin receptor RNA target for siNA mediated RNAi cleavage, wherein a plurality of siNA constructs are screened for RNAi mediated cleavage of the interleukin and/or interleukin receptor RNA target, for example, by analyzing the assay reaction by electrophoresis of labeled target RNA, or by Northern blotting, as well as by other methodology well known in the art.

Example 7

Nucleic Acid Inhibition of Interleukin and Interleukin Receptor Target RNA in Vitro siNA molecules targeted to the human interleukin and/or interleukin receptor RNA are designed and synthesized as described above. These nucleic acid molecules can be tested for cleavage activity in vivo, for example, using the following procedure. The target sequences and the nucleotide location within the interleukin and/or interleukin receptor RNA are given in Table II and III.

Two formats are used to test the efficacy of siNAs targeting interleukin and/or interleukin receptor. First, the reagents are tested in cell culture using, for example, Jurkat, HeLa, or 293T cells, to determine the extent of RNA and protein inhibition. siNA reagents (e.g.; see Tables II and III) are selected against the interleukin and/or interleukin receptor target as described herein. RNA inhibition is measured after delivery of these reagents by a suitable transfection agent to, for example, cultured Jurkat, HeLa, or 293T cells. Relative amounts of target RNA are measured versus actin using real-time PCR monitoring of amplification (e.g., ABI 7700 TAQ-MAN®). A comparison is made to a mixture of oligonucleotide sequences made to unrelated targets or to a randomized siNA control with the same overall length and chemistry, but randomly substituted at each position. Primary and secondary lead reagents are chosen for the target and optimization performed. After an optimal transfection agent concentration is chosen, a RNA time-course of inhibition is performed with the lead siNA molecule. In addition, a cell-plating format can be used to determine RNA inhibition.

Delivery of siNA to Cells

Cells (e.g., Jurkat, HeLa, or 293T cells) are seeded, for example, at $1 \times 10^5$ cells per well of a six-well dish in EGM-2 (BioWhittaker) the day before transfection. siNA (final concentration, for example 20 nM) and cationic lipid (e.g., final concentration 2 µg/ml) are complexed in EGM basal media (BioWhittaker) at 37° C. for 30 minutes in polystyrene tubes. Following vortexing, the complexed siNA is added to each well and incubated for the times indicated. For initial optimization experiments, cells are seeded, for example, at $1 \times 10^3$ in 96 well plates and siNA complex added as described. Efficiency of delivery of siNA to cells is determined using a fluorescent siNA complexed with lipid. Cells in 6-well dishes are incubated with siNA for 24 hours, rinsed with PBS and fixed in 2% paraformaldehyde for 15 minutes at room temperature. Uptake of siNA is visualized using a fluorescent microscope.

TAQMAN® (Real-Time PCR Monitoring of Amplification) and Lightcycler Quantification of mRNA Total RNA is prepared from cells following siNA delivery, for example, using Qiagen RNA purification kits for 6-well or Rneasy extraction kits for 96-well assays. For TAQMAN® analysis (real-time PCR monitoring of amplification), dual-labeled probes are synthesized with the reporter dye, FAM or JOE, covalently linked at the 5'-end and the quencher dye TAMRA conjugated to the 3'-end. One-step RT-PCR amplifications are performed on, for example, an ABI PRISM 7700 Sequence Detector using 50 µl reactions consisting of 10 µl total RNA, 100 nM forward primer, 900 nM reverse primer, 100 nM probe, 1× TaqMan PCR reaction buffer (PE-Applied Biosystems), 5.5 mM $MgCl_2$, 300 µM each dATP, dCTP, dGTP, and dTTP, 10U RNase Inhibitor (Promega), 1.25U AMPLITAQ GOLD® (DNA polymerase) (PE-Applied Biosystems) and 10U M-MLV Reverse Transcriptase (Promega). The thermal cycling conditions can consist of 30 minutes at 48° C., 10 minutes at 95° C., followed by 40 cycles of 15 seconds at 95° C. and 1 minute at 60° C. Quantitation of mRNA levels is determined relative to standards generated from serially diluted total cellular RNA (300, 100, 33, 11 ng/rxn) and normalizing to β-actin or GAPDH mRNA in parallel TAQMAN® reactions (real-time PCR monitoring of amplification). For each gene of interest an upper and lower primer and a fluorescently labeled probe are designed. Real time incorporation of SYBR Green I dye into a specific PCR product can be measured in glass capillary tubes using a lightcyler. A standard curve is generated for each primer pair using control cRNA. Values are represented as relative expression to GAPDH in each sample.

Western Blotting

Nuclear extracts can be prepared using a standard micro preparation technique (see for example Andrews and Faller, 1991, *Nucleic Acids Research*, 19, 2499). Protein extracts from supernatants are prepared, for example using TCA precipitation. An equal volume of 20% TCA is added to the cell supernatant, incubated on ice for 1 hour and pelleted by centrifugation for 5 minutes. Pellets are washed in acetone, dried and resuspended in water. Cellular protein extracts are run on a 10% Bis-Tris NuPage (nuclear extracts) or 4-12% Tris-Glycine (supernatant extracts) polyacrylamide gel and transferred onto nitro-cellulose membranes. Non-specific binding can be blocked by incubation, for example, with 5% non-fat milk for 1 hour followed by primary antibody for 16 hour at 4° C. Following washes, the secondary antibody is applied, for example (1:10,000 dilution) for 1 hour at room temperature and the signal detected with SuperSignal reagent (Pierce).

Example 8

Animal Models Useful to Evaluate the Down-Regulation of Interleukin and/or Interleukin Receptor Gene Expression Evaluating the efficacy of anti-interleukin agents in animal models is an important prerequisite to human clinical trials. Allogeneic rejection is the most common cause of corneal graft failure. King et al., 2000, Transplantation, 70, 1225-1233, describe a study investigating the kinetics of cytokine and chemokine mRNA expression before and after the onset of corneal graft rejection. Intracorneal cytokine and chemokine mRNA levels were investigated in the Brown Norway-Lewis inbred rat model, in which rejection onset is observed at 8/9 days after grafting in all animals. Nongrafted corneas and syngeneic (Lewis-Lewis) corneal transplants were used as controls. Donor and recipient cornea were examined by quantitative competitive reverse transcription-polymerase chain reaction (RT-PCR) for hypoxanthine phosphoribosyl-transferase (HPRT), CD3, CD25, interleukin (IL)-1beta, IL-1RA, IL-2, IL-6, IL-10, interferon-gamma (IFN-gamma), tumor necrosis factor (TNF), transforming growth factor (TGF)-beta1, and macrophage inflammatory protein (MIP)-2 and by RT-PCR for IL-4, IL-5, IL-12 p40, IL-13, TGF-beta.2, monocyte chemotactic protein-1 (MCP-1), MIP-1alpha, MIP-1beta, and RANTES. A biphasic expression of cytokine and chemokine mRNA was found after transplantation. During the early phase (days 3-9), there was an elevation of the majority of the cytokines examined, including IL-1beta, IL-6, IL-10, IL-12 p40, and MIP-2. There was no difference in cytokine expression patterns between allogeneic or syngeneic recipients at this time. In syngeneic recipients, cytokine levels reduced to pretransplant levels by day 13, whereas levels of all cytokines rose after the rejection onset in the allografts, including TGF-beta.1, TGF-beta.2, and IL-1RA. The T cell-derived cytokines IL-4, IL-13, and IFN-gamma were detected only during the rejection phase in allogeneic recipients. Thus, there appears to be an early cytokine and chemokine response to the transplantation process, evident in syngeneic and allogeneic grafts, that drives angiogenesis, leukocyte recruitment, and affects other leukocyte functions. After an immune response has been generated, allogeneic rejection results in the expression of Th1 cytokines, Th2 cytokines, and anti-inflammatory/Th3 cytokines. This animal model can be used to evaluate the efficacy of nucleic acid molecules of the invention targeting interleukin expression (e.g., phenotypic change, interleukin expression etc.) toward therapeutic use in treating transplant rejection. Similarly, other animal models of transplant rejection as are known in the art can be used to evaluate nucleic acid molecules (e.g., siNA) of the invention toward therapeutic use.

Other animal models are useful in evaluating the role of interleukins in asthma. For example, Kuperman et al., 2002, *Nature Medicine*, 8, 885-9, describe an animal model of IL-13 mediated asthma response animal models of allergic asthma in which blockade of IL-13 markedly inhibits allergen-induced asthma. Venkayya et al., 2002, *Am J Respir Cell Mol Biol.*, 26, 202-8 and Yang et al., 2001, *Am J Respir Cell Mol Biol.*, 25, 522-30 describe animal models of airway inflammation and airway hyperresponsiveness (AHR) in which IL-4/IL-4R and IL-13 mediate asthma. These models can be used to evaluate the efficacy of siNA molecules of the invention targeting, for example, IL-4, IL-4R, IL-13, and/or IL-13R for use is treating asthma.

Example 9

RNAi Mediated Inhibition of Interleukin and/or Interleukin Receptor Expression in Cell Culture Inhibition of Interleukin and/or Interleukin Receptor RNA Expression Using siNA Targeting Interleukin and/or Interleukin Receptor RNA siNA constructs (Table III) are tested for efficacy in reducing interleukin and/or interleukin receptor RNA expression in, for example, Jurkat, HeLa, or 293T cells. Cells are plated approximately 24 hours before transfection in 96-well plates at 5,000-7,500 cells/well, 100 µl/well, such that at the time of transfection cells are 70-90% confluent. For transfection, annealed siNAs are mixed with the transfection reagent (Lipofectamine 2000, Invitrogen) in a volume of 0.5 µl/well and incubated for 20 min. at room temperature. The siNA transfection mixtures are added to cells to give a final siNA concentration of 25 nM in a volume of 150 µl. Each siNA transfection mixture is added to 3 wells for triplicate siNA treatments. Cells are incubated at 37° for 24 h in the continued presence of the siNA transfection mixture. At 24 h, RNA is prepared from each well of treated cells. The supernatants with the transfection mixtures are first removed and discarded, then the cells are lysed and RNA prepared from each well. Target gene expression following treatment is evaluated by RT-PCR for the target gene and for a control gene (36B4, an RNA polymerase subunit) for normalization. The triplicate data is averaged and the standard deviations determined for each treatment. Normalized data are graphed and the percent reduction of target mRNA by active siNAs in comparison to their respective inverted control siNAs is determined.

In a non-limiting example, chemically modified siNA constructs (Table III) were tested for efficacy as described above in reducing IL-4R RNA expression in HeLa cells. Active siNAs were evaluated compared to a matched chemistry inverted control (IC), and a transfection control. Results are summarized in FIG. 22. FIG. 22 shows results for Stab 9/22 (Table IV) siNA constructs targeting various sites in IL-4R mRNA. As shown in FIG. 22, the active siNA constructs provide significant inhibition of IL-4R gene expression in cell culture experiments as determined by levels of IL-4R mRNA when compared to appropriate controls.

Example 10

Indications

The siNA molecule of the invention can be used to prevent, inhibit or treat cancers and other proliferative conditions, viral infection, inflammatory disease, autoimmunity, respiratory disease, pulmonary disease, cardiovascular disease, neurological disease, renal disease, ocular disease, liver disease, mitochondrial disease, endocrine disease, prion disease, reproduction related diseases and conditions, and/or any other trait, disease or condition that is related to or will respond to the levels of interleukin and/or interleukin receptor in a cell or tissue, alone or in combination with other therapies. Non-limiting examples of respiratory diseases that can be treated using siNA molecules of the invention (e.g., siNA molecules targeting IL-4, IL-4R, IL-13, and/or IL-13R include asthma, chronic obstructive pulmonary disease or "COPD", allergic rhinitis, sinusitis, pulmonary vasoconstriction, inflammation, allergies, impeded respiration, respiratory distress syndrome, cystic fibrosis, pulmonary hypertension, pulmonary vasoconstriction, emphysema.

The use of anticholinergic agents, anti-inflammatories, bronchodilators, adenosine inhibitors, adenosine A1 receptor inhibitors, non-selective M3 receptor antagonists such as atropine, ipratropium bromide and selective M3 receptor antagonists such as darifenacin and revatropate are all non-limiting examples of agents that can be combined with or used in conjunction with the nucleic acid molecules (e.g. siNA molecules) of the instant invention. Immunomodulators, chemotherapeutics, anti-inflammatory compounds, and anti-viral compounds are additional non-limiting examples of pharmaceutical agents that can be combined with or used in conjunction with the nucleic acid molecules (e.g. siNA molecules) of the instant invention. Those skilled in the art will recognize that other drugs, compounds and therapies can similarly be readily combined with the nucleic acid molecules of the instant invention (e.g. siRNA molecules) are hence within the scope of the instant invention.

Example 11

Diagnostic Uses

The siNA molecules of the invention can be used in a variety of diagnostic applications, such as in the identification of molecular targets (e.g., RNA) in a variety of applications, for example, in clinical, industrial, environmental, agricultural and/or research settings. Such diagnostic use of siNA molecules involves utilizing reconstituted RNAi systems, for example, using cellular lysates or partially purified cellular lysates. siNA molecules of this invention can be used as diagnostic tools to examine genetic drift and mutations within diseased cells or to detect the presence of endogenous or exogenous, for example viral, RNA in a cell. The close relationship between siNA activity and the structure of the target RNA allows the detection of mutations in any region of the molecule, which alters the base-pairing and three-dimensional structure of the target RNA. By using multiple siNA molecules described in this invention, one can map nucleotide changes, which are important to RNA structure and function in vitro, as well as in cells and tissues. Cleavage of target RNAs with siNA molecules can be used to inhibit gene expression and define the role of specified gene products in the progression of disease or infection. In this manner, other genetic targets can be defined as important mediators of the disease. These experiments will lead to better treatment of the disease progression by affording the possibility of combination therapies (e.g., multiple siNA molecules targeted to different genes, siNA molecules coupled with known small molecule inhibitors, or intermittent treatment with combinations siNA molecules and/or other chemical or biological molecules). Other in vitro uses of siNA molecules of this invention are well known in the art, and include detection of the presence of mRNAs associated with a disease, infection, or related condition. Such RNA is detected by determining the presence of a cleavage product after treatment with an siNA using standard methodologies, for example, fluorescence resonance emission transfer (FRET).

In a specific example, siNA molecules that cleave only wild-type or mutant forms of the target RNA are used for the assay. The first siNA molecules (i.e., those that cleave only wild-type forms of target RNA) are used to identify wild-type RNA present in the sample and the second siNA molecules (i.e., those that cleave only mutant forms of target RNA) are used to identify mutant RNA in the sample. As reaction controls, synthetic substrates of both wild-type and mutant RNA are cleaved by both siNA molecules to demonstrate the relative siNA efficiencies in the reactions and the absence of cleavage of the "non-targeted" RNA species. The cleavage products from the synthetic substrates also serve to generate size markers for the analysis of wild-type and mutant RNAs in the sample population. Thus, each analysis requires two siNA molecules, two substrates and one unknown sample, which is combined into six reactions. The presence of cleavage products is determined using an RNase protection assay so that full-length and cleavage fragments of each RNA can be analyzed in one lane of a polyacrylamide gel. It is not absolutely required to quantify the results to gain insight into the expression of mutant RNAs and putative risk of the desired phenotypic changes in target cells. The expression of mRNA whose protein product is implicated in the development of the phenotype (i.e., disease related or infection related) is adequate to establish risk. If probes of comparable specific activity are used for both transcripts, then a qualitative comparison of RNA levels is adequate and decreases the cost of the initial diagnosis. Higher mutant form to wild-type ratios are correlated with higher risk whether RNA levels are compared qualitatively or quantitatively.

All patents and publications mentioned in the specification are indicative of the levels of skill of those skilled in the art to which the invention pertains. All references cited in this disclosure are incorporated by reference to the same extent as if each reference had been incorporated by reference in its entirety individually.

One skilled in the art would readily appreciate that the present invention is well adapted to carry out the objects and obtain the ends and advantages mentioned, as well as those inherent therein. The methods and compositions described herein as presently representative of preferred embodiments are exemplary and are not intended as limitations on the scope of the invention. Changes therein and other uses will occur to those skilled in the art, which are encompassed within the spirit of the invention, are defined by the scope of the claims.

It will be readily apparent to one skilled in the art that varying substitutions and modifications can be made to the invention disclosed herein without departing from the scope and spirit of the invention. Thus, such additional embodiments are within the scope of the present invention and the following claims. The present invention teaches one skilled in the art to test various combinations and/or substitutions of chemical modifications described herein toward generating nucleic acid constructs with improved activity for mediating RNAi activity. Such improved activity can comprise improved stability, improved bioavailability, and/or improved activation of cellular responses mediating RNAi. Therefore, the specific embodiments described herein are not limiting and one skilled in the art can readily appreciate that specific combinations of the modifications described herein can be tested without undue experimentation toward identifying siNA molecules with improved RNAi activity.

The invention illustratively described herein suitably can be practiced in the absence of any element or elements, limitation or limitations that are not specifically disclosed herein. Thus, for example, in each instance herein any of the terms "comprising", "consisting essentially of", and "consisting of" may be replaced with either of the other two terms. The terms and expressions which have been employed are used as terms of description and not of limitation, and there is no intention that in the use of such terms and expressions of excluding any equivalents of the features shown and described or portions thereof, but it is recognized that various modifications are possible within the scope of the invention claimed. Thus, it should be understood that although the present invention has been specifically disclosed by preferred embodiments, optional features, modification and variation of the concepts herein disclosed may be resorted to by those skilled in the art, and that such modifications and variations are considered to be within the scope of this invention as defined by the description and the appended claims.

In addition, where features or aspects of the invention are described in terms of Markush groups or other grouping of alternatives, those skilled in the art will recognize that the invention is also thereby described in terms of any individual member or subgroup of members of the Markush group or other group.

TABLE I interleukin and/or interleukin receptor Accession Numbers

Interleukin Family

NM_000575 *Homo sapiens* interleukin 1, alpha (IL1A), mRNA
NM_000576 *Homo sapiens* interleukin 1, beta (IL1B), mRNA
NM_012275 *Homo sapiens* interleukin 1 family, member 5 (delta) (IL1F5), mRNA
NM_014440 *Homo sapiens* interleukin 1 family, member 6 (epsilon) (IL1F6), mRNA
NM_014439 *Homo sapiens* interleukin 1 family, member 7 (zeta) (IL1F7), mRNA
NM_014438 *Homo sapiens* interleukin 1 family, member 8 (eta) (IL1F8), mRNA
NM_019618 *Homo sapiens* interleukin 1 family, member 9 (IL1F9), mRNA
NM_032556 *Homo sapiens* interleukin 1 family, member 10 (theta) (IL1F10), mRNA

TABLE I-continued interleukin and/or interleukin receptor Accession Numbers

NM_000586 *Homo sapiens* interleukin 2 (IL2), mRNA
NM_000588 *Homo sapiens* interleukin 3 (colony-stimulating factor, multiple) (IL3), mRNA
NM_000589 *Homo sapiens* interleukin 4 (IL4), mRNA
NM_000879 *Homo sapiens* interleukin 5 (colony-stimulating factor, eosinophil) (IL5), mRNA
NM_000600 *Homo sapiens* interleukin 6 (interferon, beta 2) (IL6), mRNA
NM_000880 *Homo sapiens* interleukin 7 (IL7), mRNA
NM_000584 *Homo sapiens* interleukin 8 (IL8), mRNA
NM_000590 *Homo sapiens* interleukin 9 (IL9), mRNA
NM_000572 *Homo sapiens* interleukin 10 (IL10), mRNA
NM_000641 *Homo sapiens* interleukin 11 (IL11), mRNA
NM_000882 *Homo sapiens* interleukin 12A (natural killer cell stimulatory factor 1, cytotoxic lymphocyte maturation factor 1, p35) (IL12A), mRNA
NM_002187 *Homo sapiens* interleukin 12B (natural killer cell stimulatory factor 2, cytotoxic lymphocyte maturation factor 2, p40) (IL12B), mRNA
NM_002188 *Homo sapiens* interleukin 13 (IL13), mRNA
L15344 *Homo sapiens* interleukin 14 (IL14), mRNA
NM_000585 *Homo sapiens* interleukin 15 (IL15), mRNA
NM_004513 *Homo sapiens* interleukin 16 (lymphocyte chemoattractant factor) (IL16), mRNA
NM_002190 *Homo sapiens* interleukin 17 (cytotoxic T-lymphocyte-associated serine esterase 8) (IL17), mRNA
NM_014443 *Homo sapiens* interleukin 17B (IL17B), mRNA
NM_013278 *Homo sapiens* interleukin 17C (IL17C), mRNA
NM_138284 *Homo sapiens* interleukin 17D (IL17D), mRNA
NM_022789 *Homo sapiens* interleukin 17E (IL17E), mRNA
NM_052872 *Homo sapiens* interleukin 17F (IL17F), mRNA
NM_001562 *Homo sapiens* interleukin 18 (interferon-gamma-inducing factor) (IL18), mRNA
NM_013371 *Homo sapiens* interleukin 19 (IL19), mRNA
NM_018724 *Homo sapiens* interleukin 20 (IL20), mRNA
NM_021803 *Homo sapiens* interleukin 21 (IL21 antisense), mRNA
NM_020525 *Homo sapiens* interleukin 22 (IL22), mRNA
NM_016584 *Homo sapiens* interleukin 23, alpha subunit p19 (IL23A), mRNA
NM_006850 *Homo sapiens* interleukin 24 (IL24), mRNA
NM_018402 *Homo sapiens* interleukin 26 (IL26), mRNA
AL365373 *Homo sapiens* interleukin 27 (IL27), mRNA

Interleukin Receptor Family

NM_000877 *Homo sapiens* interleukin 1 receptor, type I (IL1R1), mRNA
NM_004633 *Homo sapiens* interleukin 1 receptor, type II (IL1R2), mRNA
NM_016232 *Homo sapiens* interleukin 1 receptor-like 1 (IL1RL1), mRNA
NM_003856 *Homo sapiens* interleukin 1 receptor-like 1 (IL1RL1), mRNA
NM_003854 *Homo sapiens* interleukin 1 receptor-like 2 (IL1RL2), mRNA
NM_000417 *Homo sapiens* interleukin 2 receptor, alpha (IL2RA), mRNA
NM_000878 *Homo sapiens* interleukin 2 receptor, beta (IL2RB), mRNA
NM_000206 *Homo sapiens* interleukin 2 receptor, gamma (severe combined immunodeficiency) (IL2RG), mRNA
NM_002183 *Homo sapiens* interleukin 3 receptor, alpha (low affinity) (IL3RA), mRNA
NM_000418 *Homo sapiens* interleukin 4 receptor (IL4R), mRNA
NM_000564 *Homo sapiens* interleukin 5 receptor, alpha (IL5RA), mRNA
NM_000565 *Homo sapiens* interleukin 6 receptor (IL6R), mRNA
NM_002185 *Homo sapiens* interleukin 7 receptor (IL7R), mRNA
NM_000634 *Homo sapiens* interleukin 8 receptor, alpha (IL8RA), mRNA
NM_001557 *Homo sapiens* interleukin 8 receptor, beta (IL8RB), mRNA
NM_002186 *Homo sapiens* interleukin 9 receptor (IL9R), mRNA
NM_001558 *Homo sapiens* interleukin 10 receptor, alpha (IL10RA), mRNA
NM_000628 *Homo sapiens* interleukin 10 receptor, beta (IL10RB), mRNA
NM_004512 *Homo sapiens* interleukin 11 receptor, alpha (IL11RA), mRNA
NM_005535 *Homo sapiens* interleukin 12 receptor, beta 1 (IL12RB1), mRNA
NM_001559 *Homo sapiens* interleukin 12 receptor, beta 2 (IL12RB2), mRNA
NM_001560 *Homo sapiens* interleukin 13 receptor, alpha 1 (IL13RA1), mRNA
NM_000640 *Homo sapiens* interleukin 13 receptor, alpha 2 (IL13RA2), mRNA
NM_002189 *Homo sapiens* interleukin 15 receptor, alpha (IL15RA), mRNA
NM_014339 *Homo sapiens* interleukin 17 receptor (IL17R), mRNA
NM_032732 *Homo sapiens* interleukin 17 receptor C (IL-17RC), mRNA
NM_144640 *Homo sapiens* interleukin 17 receptor E (IL-17RE), mRNA
NM_018725 *Homo sapiens* interleukin 17B receptor (IL17BR), mRNA
NM_003855 *Homo sapiens* interleukin 18 receptor 1 (IL18R1), mRNA
NM_003853 *Homo sapiens* interleukin 18 receptor accessory protein (IL18RAP), mRNA
NM_014432 *Homo sapiens* interleukin 20 receptor, alpha (IL20RA), mRNA
NM_021798 *Homo sapiens* interleukin 21 receptor (IL21 antisenseR), mRNA
NM_021258 *Homo sapiens* interleukin 22 receptor (IL22R), mRNA
NM_144701 *Homo sapiens* interleukin 23 receptor (IL23R), mRNA

Interleukin Associated Proteins

NM_004514 *Homo sapiens* interleukin enhancer binding factor 1 (ILF1), mRNA
NM_004515 *Homo sapiens* interleukin enhancer binding factor 2, 45 kD (ILF2), mRNA
NM_012218 *Homo sapiens* interleukin enhancer binding factor 3, 90 kD (ILF3), mRNA
NM_004516 *Homo sapiens* interleukin enhancer binding factor 3, 90 kD (ILF3), mRNA
NM_016123 *Homo sapiens* interleukin-1 receptor associated kinase 4 (IRAK4), mRNA
NM_001569 *Homo sapiens* interleukin-1 receptor-associated kinase 1 (IRAK1), mRNA
NM_001570 *Homo sapiens* interleukin-1 receptor-associated kinase 2 (IRAK2), mRNA
NM_007199 *Homo sapiens* interleukin-1 receptor-associated kinase 3 (IRAK3), mRNA
NM_134470 *Homo sapiens* interleukin 1 receptor accessory protein (IL1RAP), mRNA
NM_002182 *Homo sapiens* interleukin 1 receptor accessory protein (IL1RAP), mRNA
NM_014271 *Homo sapiens* interleukin 1 receptor accessory protein-like 1 (IL1RAPL1), mRNA
NM_017416 *Homo sapiens* interleukin 1 receptor accessory protein-like 2 (IL1RAPL2), mRNA
NM_000577 *Homo sapiens* interleukin 1 receptor antagonist (IL1RN), mRNA
NM_002184 *Homo sapiens* interleukin 6 signal transducer (gp130, oncostatin M receptor) (IL6ST), mRNA
NM_005699 *Homo sapiens* interleukin 18 binding protein (IL18BP), mRNA

TABLE II

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| | | | | IL2RG NM_000206 | | | | |
| 3 | AGAGCAAGCGCCAUGUUGA | 1 | 3 | AGAGCAAGCGCCAUGUUGA | 1 | 25 | UCAACAUGGCGCUUGCUCU | 82 |
| 21 | AAGCCAUCAUUACCAUUCA | 2 | 21 | AAGCCAUCAUUACCAUUCA | 2 | 43 | UGAAUGGUAAUGAUGGCUU | 83 |
| 39 | ACAUCCCUCUUAUUCCUGC | 3 | 39 | ACAUCCCUCUUAUUCCUGC | 3 | 61 | GCAGGAAUAAGAGGGAUGU | 84 |
| 57 | CAGCUGCCCCUGCUGGGAG | 4 | 57 | CAGCUGCCCCUGCUGGGAG | 4 | 79 | CUCCCAGCAGGGGCAGCUG | 85 |
| 75 | GUGGGGCUGAACACGACAA | 5 | 75 | GUGGGGCUGAACACGACAA | 5 | 97 | UUGUCGUGUUCAGCCCCAC | 86 |
| 93 | AUUCUGACGCCCAAUGGGA | 6 | 93 | AUUCUGACGCCCAAUGGGA | 6 | 115 | UCCCAUUGGGCGUCAGAAU | 87 |
| 111 | AAUGAAGACACCACAGCUG | 7 | 111 | AAUGAAGACACCACAGCUG | 7 | 133 | CAGCUGUGGUGUCUUCAUU | 88 |
| 129 | GAUUUCUUCCUGACCACUA | 8 | 129 | GAUUUCUUCCUGACCACUA | 8 | 151 | UAGUGGUCAGGAAGAAAUC | 89 |
| 147 | AUGCCCACUGACUCCCUCA | 9 | 147 | AUGCCCACUGACUCCCUCA | 9 | 169 | UGAGGGAGUCAGUGGGCAU | 90 |
| 165 | AGUGUUUCCACUCUGCCCC | 10 | 165 | AGUGUUUCCACUCUGCCCC | 10 | 187 | GGGGCAGAGUGGAAACACU | 91 |
| 183 | CUCCCAGAGGUUCAGUGUU | 11 | 183 | CUCCCAGAGGUUCAGUGUU | 11 | 205 | AACACUGAACCUCUGGGAG | 92 |
| 201 | UUUGUGUUCAAUGUCGAGU | 12 | 201 | UUUGUGUUCAAUGUCGAGU | 12 | 223 | ACUCGACAUUGAACACAAA | 93 |
| 219 | UACAUGAAUUGCACUUGGA | 13 | 219 | UACAUGAAUUGCACUUGGA | 13 | 241 | UCCAAGUGCAAUUCAUGUA | 94 |
| 237 | AACAGCAGCUCUGAGCCCC | 14 | 237 | AACAGCAGCUCUGAGCCCC | 14 | 259 | GGGGCUCAGAGCUGCUGUU | 95 |
| 255 | CAGCCUACCAACCUCACUC | 15 | 255 | CAGCCUACCAACCUCACUC | 15 | 277 | GAGUGAGGUUGGUAGGCUG | 96 |
| 273 | CUGCAUUAUUGGUACAAGA | 16 | 273 | CUGCAUUAUUGGUACAAGA | 16 | 295 | UCUUGUACCAAUAAUGCAG | 97 |
| 291 | AACUCGGAUAAUGAUAAAG | 17 | 291 | AACUCGGAUAAUGAUAAAG | 17 | 313 | CUUUAUCAUUAUCCGAGUU | 98 |
| 309 | GUCCAGAAGUGCAGCCACU | 18 | 309 | GUCCAGAAGUGCAGCCACU | 18 | 331 | AGUGGCUGCACUUCUGGAC | 99 |
| 327 | UAUCUAUUCUCUGAAGAAA | 19 | 327 | UAUCUAUUCUCUGAAGAAA | 19 | 349 | UUUCUUCAGAGAAUAGAUA | 100 |
| 345 | AUCACUUCUGGCUGUCAGU | 20 | 345 | AUCACUUCUGGCUGUCAGU | 20 | 367 | ACUGACAGCCAGAAGUGAU | 101 |
| 363 | UUGCAAAAAAGGAGAUCC | 21 | 363 | UUGCAAAAAAGGAGAUCC | 21 | 385 | GGAUCUCCUUUUUUGCAA | 102 |
| 381 | CACCUCUACCAAACAUUUG | 22 | 381 | CACCUCUACCAAACAUUUG | 22 | 403 | CAAAUGUUUGGUAGAGGUG | 103 |
| 399 | GUUGUUCAGCUCCAGGACC | 23 | 399 | GUUGUUCAGCUCCAGGACC | 23 | 421 | GGUCCUGGAGCUGAACAAC | 104 |
| 417 | CCACGGGAACCCAGGAGAC | 24 | 417 | CCACGGGAACCCAGGAGAC | 24 | 439 | GUCUCCUGGGUUCCCGUGG | 105 |
| 435 | CAGGCCACACAGAUGCUAA | 25 | 435 | CAGGCCACACAGAUGCUAA | 25 | 457 | UUAGCAUCUGUGUGGCCUG | 106 |
| 453 | AAACUGCAGAAUCUGGUGA | 26 | 453 | AAACUGCAGAAUCUGGUGA | 26 | 475 | UCACCAGAUUCUGCAGUUU | 107 |
| 471 | AUCCCCUGGGCUCCAGAGA | 27 | 471 | AUCCCCUGGGCUCCAGAGA | 27 | 493 | UCUCUGGAGCCCAGGGGAU | 108 |
| 489 | AACCUAACACUUCACAAAC | 28 | 489 | AACCUAACACUUCACAAAC | 28 | 511 | GUUUGUGAAGUGUUAGGUU | 109 |
| 507 | CUGAGUGAAUCCCAGCUAG | 29 | 507 | CUGAGUGAAUCCCAGCUAG | 29 | 529 | CUAGCUGGGAUUCACUCAG | 110 |
| 525 | GAACUGAACUGGAACAACA | 30 | 525 | GAACUGAACUGGAACAACA | 30 | 547 | UGUUGUUCCAGUUCAGUUC | 111 |
| 543 | AGAUUCUUGAACCACUGUU | 31 | 543 | AGAUUCUUGAACCACUGUU | 31 | 565 | AACAGUGGUUCAAGAAUCU | 112 |
| 561 | UUGGAGCACUUGGUGCAGU | 32 | 561 | UUGGAGCACUUGGUGCAGU | 32 | 583 | ACUGCACCAAGUGCUCCAA | 113 |
| 579 | UACCGGACUGACUGGGACC | 33 | 579 | UACCGGACUGACUGGGACC | 33 | 601 | GGUCCCAGUCAGUCCGGUA | 114 |
| 597 | CACAGCUGGACUGAACAAU | 34 | 597 | CACAGCUGGACUGAACAAU | 34 | 619 | AUUGUUCAGUCCAGCUGUG | 115 |
| 615 | UCAGUGGAUUAUAGACAUA | 35 | 615 | UCAGUGGAUUAUAGACAUA | 35 | 637 | UAUGUCUAUAAUCCACUGA | 116 |
| 633 | AAGUUCUCCUUGCCUAGUG | 36 | 633 | AAGUUCUCCUUGCCUAGUG | 36 | 655 | CACUAGGCAAGGAGAACUU | 117 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 651 | GUGGAUGGGCAGAAACGCU | 37 | 651 | GUGGAUGGGCAGAAACGCU | 37 | 673 | AGCGUUUCUGCCCAUCCAC | 118 |
| 669 | UACACGUUUCGUGUUCGGA | 38 | 669 | UACACGUUUCGUGUUCGGA | 38 | 691 | UCCGAACACGAAACGUGUA | 119 |
| 687 | AGCCGCUUUAACCCACUCU | 39 | 687 | AGCCGCUUUAACCCACUCU | 39 | 709 | AGAGUGGGUUAAAGCGGCU | 120 |
| 705 | UGUGGAAGUGCUCAGCAUU | 40 | 705 | UGUGGAAGUGCUCAGCAUU | 40 | 727 | AAUGCUGAGCACUUCCACA | 121 |
| 723 | UGGAGUGAAUGGAGCCACC | 41 | 723 | UGGAGUGAAUGGAGCCACC | 41 | 745 | GGUGGCUCCAUUCACUCCA | 122 |
| 741 | CCAAUCCACUGGGGGAGCA | 42 | 741 | CCAAUCCACUGGGGGAGCA | 42 | 763 | UGCUCCCCAGUGGAUUGG | 123 |
| 759 | AAUACUUCAAAAGAGAAUC | 43 | 759 | AAUACUUCAAAAGAGAAUC | 43 | 781 | GAUUCUCUUUUGAAGUAUU | 124 |
| 777 | CCUUUCCUGUUUGCAUUGG | 44 | 777 | CCUUUCCUGUUUGCAUUGG | 44 | 799 | CCAAUGCAAACAGGAAAGG | 125 |
| 795 | GAAGCCGUGGUUAUCUCUG | 45 | 795 | GAAGCCGUGGUUAUCUCUG | 45 | 817 | CAGAGAUAACCACGGCUUC | 126 |
| 813 | GUUGGCUCCAUGGGAUUGA | 46 | 813 | GUUGGCUCCAUGGGAUUGA | 46 | 835 | UCAAUCCCAUGGAGCCAAC | 127 |
| 831 | AUUAUCAGCCUUCUCUGUG | 47 | 831 | AUUAUCAGCCUUCUCUGUG | 47 | 853 | CACAGAGAAGGCUGAUAAU | 128 |
| 849 | GUGUAUUUCUGGCUGGAAC | 48 | 849 | GUGUAUUUCUGGCUGGAAC | 48 | 871 | GUUCCAGCCAGAAAUACAC | 129 |
| 867 | CGGACGAUGCCCCGAAUUC | 49 | 867 | CGGACGAUGCCCCGAAUUC | 49 | 889 | GAAUUCGGGGCAUCGUCCG | 130 |
| 885 | CCCACCCUGAAGAACCUAG | 50 | 885 | CCCACCCUGAAGAACCUAG | 50 | 907 | CUAGGUUCUUCAGGGUGGG | 131 |
| 903 | GAGGAUCUUGUUACUGAAU | 51 | 903 | GAGGAUCUUGUUACUGAAU | 51 | 925 | AUUCAGUAACAAGAUCCUC | 132 |
| 921 | UACCACGGGAACUUUUCGG | 52 | 921 | UACCACGGGAACUUUUCGG | 52 | 943 | CCGAAAAGUUCCCGUGGUA | 133 |
| 939 | GCCUGGAGUGGUGUGUCUA | 53 | 939 | GCCUGGAGUGGUGUGUCUA | 53 | 961 | UAGACACACCACUCCAGGC | 134 |
| 957 | AAGGGACUGGCUGAGAGUC | 54 | 957 | AAGGGACUGGCUGAGAGUC | 54 | 979 | GACUCUCAGCCAGUCCCUU | 135 |
| 975 | CUGCAGCCAGACUACAGUG | 55 | 975 | CUGCAGCCAGACUACAGUG | 55 | 997 | CACUGUAGUCUGGCUGCAG | 136 |
| 993 | GAACGACUCUGCCUCGUCA | 56 | 993 | GAACGACUCUGCCUCGUCA | 56 | 1015 | UGACGAGGCAGAGUCGUUC | 137 |
| 1011 | AGUGAGAUUCCCCCAAAAG | 57 | 1011 | AGUGAGAUUCCCCCAAAAG | 57 | 1033 | CUUUUGGGGGAAUCUCACU | 138 |
| 1029 | GGAGGGGCCCUUGGGGAGG | 58 | 1029 | GGAGGGGCCCUUGGGGAGG | 58 | 1051 | CCUCCCAAGGGCCCCUCC | 139 |
| 1047 | GGGCCUGGGGCCUCCCCAU | 59 | 1047 | GGGCCUGGGGCCUCCCCAU | 59 | 1069 | AUGGGGAGGCCCCAGGCCC | 140 |
| 1065 | UGCAACCAGCAUAGCCCCU | 60 | 1065 | UGCAACCAGCAUAGCCCCU | 60 | 1087 | AGGGGCUAUGCUGGUUGCA | 141 |
| 1083 | UACUGGGCCCCCCAUGUU | 61 | 1083 | UACUGGGCCCCCCAUGUU | 61 | 1105 | AACAUGGGGGGCCCAGUA | 142 |
| 1101 | UACACCCUAAAGCCUGAAA | 62 | 1101 | UACACCCUAAAGCCUGAAA | 62 | 1123 | UUUCAGGCUUUAGGGUGUA | 143 |
| 1119 | ACCUGAACCCCAAUCCUCU | 63 | 1119 | ACCUGAACCCCAAUCCUCU | 63 | 1141 | AGAGGAUUGGGGUUCAGGU | 144 |
| 1137 | UGACAGAAGAACCCCAGGG | 64 | 1137 | UGACAGAAGAACCCCAGGG | 64 | 1159 | CCCUGGGGUUCUUCUGUCA | 145 |
| 1155 | GUCCUGUAGCCCUAAGUGG | 65 | 1155 | GUCCUGUAGCCCUAAGUGG | 65 | 1177 | CCACUUAGGGCUACAGGAC | 146 |
| 1173 | GUACUAACUUUCCUUCAUU | 66 | 1173 | GUACUAACUUUCCUUCAUU | 66 | 1195 | AAUGAAGGAAAGUUAGUAC | 147 |
| 1191 | UCAACCCACCUGCGUCUCA | 67 | 1191 | UCAACCCACCUGCGUCUCA | 67 | 1213 | UGAGACGCAGGUGGGUUGA | 148 |
| 1209 | AUACUCACCUCACCCCACU | 68 | 1209 | AUACUCACCUCACCCCACU | 68 | 1231 | AGUGGGGUGAGGUGAGUAU | 149 |
| 1227 | UGUGGCUGAUUUGGAAUUU | 69 | 1227 | UGUGGCUGAUUUGGAAUUU | 69 | 1249 | AAAUUCCAAAUCAGCCACA | 150 |
| 1245 | UUGUGCCCCAUGUAAGCA | 70 | 1245 | UUGUGCCCCAUGUAAGCA | 70 | 1267 | UGCUUACAUGGGGCACAA | 151 |
| 1263 | ACCCCUUCAUUUGGCAUUC | 71 | 1263 | ACCCCUUCAUUUGGCAUUC | 71 | 1285 | GAAUGCCAAAUGAAGGGGU | 152 |
| 1281 | CCCCACUUGAGAAUUACCC | 72 | 1281 | CCCCACUUGAGAAUUACCC | 72 | 1303 | GGGUAAUUCUCAAGUGGGG | 153 |
| 1299 | CUUUUGCCCCGAACAUGUU | 73 | 1299 | CUUUUGCCCCGAACAUGUU | 73 | 1321 | AACAUGUUCGGGGCAAAAG | 154 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 1317 | UUUUCUUCUCCCUCAGUCU | 74 | 1317 | UUUUCUUCUCCCUCAGUCU | 74 | 1339 | AGACUGAGGGAGAAGAAAA | 155 |
| 1335 | UGGCCCUUCCUUUUCGCAG | 75 | 1335 | UGGCCCUUCCUUUUCGCAG | 75 | 1357 | CUGCGAAAAGGAAGGGCCA | 156 |
| 1353 | GGAUUCUUCCUCCCUCCCU | 76 | 1353 | GGAUUCUUCCUCCCUCCCU | 76 | 1375 | AGGGAGGGAGGAAGAAUCC | 157 |
| 1371 | UCUUUCCCUCCCUUCCUCU | 77 | 1371 | UCUUUCCCUCCCUUCCUCU | 77 | 1393 | AGAGGAAGGGAGGGAAAGA | 158 |
| 1389 | UUUCCAUCUACCCUCCGAU | 78 | 1389 | UUUCCAUCUACCCUCCGAU | 78 | 1411 | AUCGGAGGGUAGAUGGAAA | 159 |
| 1407 | UUGUUCCUGAACCGAUGAG | 79 | 1407 | UUGUUCCUGAACCGAUGAG | 79 | 1429 | CUCAUCGGUUCAGGAACAA | 160 |
| 1425 | GAAAUAAAGUUUCUGUUGA | 80 | 1425 | GAAAUAAAGUUUCUGUUGA | 80 | 1447 | UCAACAGAAACUUUAUUUC | 161 |
| 1431 | AAGUUUCUGUUGAUAAUCA | 81 | 1431 | AAGUUUCUGUUGAUAAUCA | 81 | 1453 | UGAUUAUCAACAGAAACUU | 162 |

IL4 NM_000589

| Pos | Seq | Seq ID | UPos | Upper seq | Seq ID | LPos | Lower seq | Seq ID |
|---|---|---|---|---|---|---|---|---|
| 3 | CUAUGCAAAGCAAAAAGCC | 163 | 3 | CUAUGCAAAGCAAAAAGCC | 163 | 25 | GGCUUUUUGCUUUGCAUAG | 214 |
| 21 | CAGCAGCAGCCCCAAGCUG | 164 | 21 | CAGCAGCAGCCCCAAGCUG | 164 | 43 | CAGCUUGGGGCUGCUGCUG | 215 |
| 39 | GAUAAGAUUAAUCUAAAGA | 165 | 39 | GAUAAGAUUAAUCUAAAGA | 165 | 61 | UCUUUAGAUUAAUCUUAUC | 216 |
| 57 | AGCAAAUUAUGGUGUAAUU | 166 | 57 | AGCAAAUUAUGGUGUAAUU | 166 | 79 | AAUUACACCAUAAUUUGCU | 217 |
| 75 | UUCCUAUGCUGAAACUUUG | 167 | 75 | UUCCUAUGCUGAAACUUUG | 167 | 97 | CAAAGUUUCAGCAUAGGAA | 218 |
| 93 | GUAGUUAAUUUUUUAAAAA | 168 | 93 | GUAGUUAAUUUUUUAAAAA | 168 | 115 | UUUUUAAAAAAUUAACUAC | 219 |
| 111 | AGGUUUCAUUUUCCUAUUG | 169 | 111 | AGGUUUCAUUUUCCUAUUG | 169 | 133 | CAAUAGGAAAAUGAAACCU | 220 |
| 129 | GGUCUGAUUUCACAGGAAC | 170 | 129 | GGUCUGAUUUCACAGGAAC | 170 | 151 | GUUCCUGUGAAAUCAGACC | 221 |
| 147 | CAUUUUACCUGUUUGUGAG | 171 | 147 | CAUUUUACCUGUUUGUGAG | 171 | 169 | CUCACAAACAGGUAAAAUG | 222 |
| 165 | GGCAUUUUUUCUCCUGGAA | 172 | 165 | GGCAUUUUUUCUCCUGGAA | 172 | 187 | UUCCAGGAGAAAAAUGCC | 223 |
| 183 | AGAGAGGUGCUGAUUGGCC | 173 | 183 | AGAGAGGUGCUGAUUGGCC | 173 | 205 | GGCCAAUCAGCACCUCUCU | 224 |
| 201 | CCCAAGUGACUGACAAUCU | 174 | 201 | CCCAAGUGACUGACAAUCU | 174 | 223 | AGAUUGUCAGUCACUUGGG | 225 |
| 219 | UGGUGUAACGAAAAUUUCC | 175 | 219 | UGGUGUAACGAAAAUUUCC | 175 | 241 | GGAAAUUUUCGUUACACCA | 226 |
| 237 | CAAUGUAAACUCAUUUUCC | 176 | 237 | CAAUGUAAACUCAUUUUCC | 176 | 259 | GGAAAAUGAGUUUACAUUG | 227 |
| 255 | CCUCGGUUUCAGCAAUUUU | 177 | 255 | CCUCGGUUUCAGCAAUUUU | 177 | 277 | AAAAUUGCUGAAACCGAGG | 228 |
| 273 | UAAAUCUAUAUAUAGAGAU | 178 | 273 | UAAAUCUAUAUAUAGAGAU | 178 | 295 | AUCUCUAUAUAUAGAUUUA | 229 |
| 291 | UAUCUUUGUCAGCAUUGCA | 179 | 291 | UAUCUUUGUCAGCAUUGCA | 179 | 313 | UGCAAUGCUGACAAAGAUA | 230 |
| 309 | AUCGUUAGCUUCUCCUGAU | 180 | 309 | AUCGUUAGCUUCUCCUGAU | 180 | 331 | AUCAGGAGAAGCUAACGAU | 231 |
| 327 | UAAACUAAUUGCCUCACAU | 181 | 327 | UAAACUAAUUGCCUCACAU | 181 | 349 | AUGUGAGGCAAUUAGUUUA | 232 |
| 345 | UUGUCACUGCAAAUCGACA | 182 | 345 | UUGUCACUGCAAAUCGACA | 182 | 367 | UGUCGAUUUGCAGUGACAA | 233 |
| 363 | ACCUAUUAAUGGGUCUCAC | 183 | 363 | ACCUAUUAAUGGGUCUCAC | 183 | 385 | GUGAGACCCAUUAAUAGGU | 234 |
| 381 | CCUCCCAACUGCUUCCCCC | 184 | 381 | CCUCCCAACUGCUUCCCCC | 184 | 403 | GGGGGAAGCAGUUGGGAGG | 235 |
| 399 | CUCUGUUCUUCCUGCUAGC | 185 | 399 | CUCUGUUCUUCCUGCUAGC | 185 | 421 | GCUAGCAGGAAGAACAGAG | 236 |
| 417 | CAUGUGCCGGCAACUUUGU | 186 | 417 | CAUGUGCCGGCAACUUUGU | 186 | 439 | ACAAAGUUGCCGGCACAUG | 237 |
| 435 | UCCACGGACACAAGUGCGA | 187 | 435 | UCCACGGACACAAGUGCGA | 187 | 457 | UCGCACUUGUGUCCGUGGA | 238 |
| 453 | AUAUCACCUUACAGGAGAU | 188 | 453 | AUAUCACCUUACAGGAGAU | 188 | 475 | AUCUCCUGUAAGGUGAUAU | 239 |
| 471 | UCAUCAAAACUUUGAACAG | 189 | 471 | UCAUCAAAACUUUGAACAG | 189 | 493 | CUGUUCAAAGUUUUGAUGA | 240 |
| 489 | GCCUCACAGAGCAGAAGAC | 190 | 489 | GCCUCACAGAGCAGAAGAC | 190 | 511 | GUCUUCUGCUCUGUGAGGC | 241 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 507 | CUCUGUGCACCGAGUUGAC | 191 | 507 | CUCUGUGCACCGAGUUGAC | 191 | 529 | GUCAACUCGGUGCACAGAG | 242 |
| 525 | CCGUAACAGACAUCUUUGC | 192 | 525 | CCGUAACAGACAUCUUUGC | 192 | 547 | GCAAAGAUGUCUGUUACGG | 243 |
| 543 | CUGCCUCCAAGAACACAAC | 193 | 543 | CUGCCUCCAAGAACACAAC | 193 | 565 | GUUGUGUUCUUGGAGGCAG | 244 |
| 561 | CUGAGAAGGAAACCUUCUG | 194 | 561 | CUGAGAAGGAAACCUUCUG | 194 | 583 | CAGAAGGUUUCCUUCUCAG | 245 |
| 579 | GCAGGGCUGCGACUGUGCU | 195 | 579 | GCAGGGCUGCGACUGUGCU | 195 | 601 | AGCACAGUCGCAGCCCUGC | 246 |
| 597 | UCCGGCAGUUCUACAGCCA | 196 | 597 | UCCGGCAGUUCUACAGCCA | 196 | 619 | UGGCUGUAGAACUGCCGGA | 247 |
| 615 | ACCAUGAGAAGGACACUCG | 197 | 615 | ACCAUGAGAAGGACACUCG | 197 | 637 | CGAGUGUCCUUCUCAUGGU | 248 |
| 633 | GCUGCCUGGGUGCGACUGC | 198 | 633 | GCUGCCUGGGUGCGACUGC | 198 | 655 | GCAGUCGCACCCAGGCAGC | 249 |
| 651 | CACAGCAGUUCCACAGGCA | 199 | 651 | CACAGCAGUUCCACAGGCA | 199 | 673 | UGCCUGUGGAACUGCUGUG | 250 |
| 669 | ACAAGCAGCUGAUCCGAUU | 200 | 669 | ACAAGCAGCUGAUCCGAUU | 200 | 691 | AAUCGGAUCAGCUGCUUGU | 251 |
| 687 | UCCUGAAACGGCUCGACAG | 201 | 687 | UCCUGAAACGGCUCGACAG | 201 | 709 | CUGUCGAGCCGUUUCAGGA | 252 |
| 705 | GGAACCUCUGGGGCCUGGC | 202 | 705 | GGAACCUCUGGGGCCUGGC | 202 | 727 | GCCAGGCCCCAGAGGUUCC | 253 |
| 723 | CGGGCUUGAAUUCCUGUCC | 203 | 723 | CGGGCUUGAAUUCCUGUCC | 203 | 745 | GGACAGGAAUUCAAGCCCG | 254 |
| 741 | CUGUGAAGGAAGCCAACCA | 204 | 741 | CUGUGAAGGAAGCCAACCA | 204 | 763 | UGGUUGGCUUCCUUCACAG | 255 |
| 759 | AGAGUACGUUGGAAAACUU | 205 | 759 | AGAGUACGUUGGAAAACUU | 205 | 781 | AAGUUUUCCAACGUACUCU | 256 |
| 777 | UCUUGGAAAGGCUAAAGAC | 206 | 777 | UCUUGGAAAGGCUAAAGAC | 206 | 799 | GUCUUUAGCCUUUCCAAGA | 257 |
| 795 | CGAUCAUGAGAGAGAAAUA | 207 | 795 | CGAUCAUGAGAGAGAAAUA | 207 | 817 | UAUUUCUCUCUCAUGAUCG | 258 |
| 813 | AUUCAAAGUGUUCGAGCUG | 208 | 813 | AUUCAAAGUGUUCGAGCUG | 208 | 835 | CAGCUCGAACACUUUGAAU | 259 |
| 831 | GAAUAUUUAAUUUAUGAG | 209 | 831 | GAAUAUUUAAUUUAUGAG | 209 | 853 | CUCAUAAAUUAAAAUAUUC | 260 |
| 849 | GUUUUUGAUAGCUUUAUUU | 210 | 849 | GUUUUUGAUAGCUUUAUUU | 210 | 871 | AAAUAAAGCUAUCAAAAAC | 261 |
| 867 | UUUUAAGUAUUUAUAUAUU | 211 | 867 | UUUUAAGUAUUUAUAUAUU | 211 | 889 | AAUAUAUAAAUACUUAAAA | 262 |
| 885 | UUAUAACUCAUCAUAAAAU | 212 | 885 | UUAUAACUCAUCAUAAAAU | 212 | 907 | AUUUUAUGAUGAGUUAUAA | 263 |
| 901 | AAUAAAGUAUAUAUAGAAU | 213 | 901 | AAUAAAGUAUAUAUAGAAU | 213 | 923 | AUUCUAUAUAUACUUUAUU | 264 |
| | IL4R NM_000418 | | | | | | | |
| 3 | CGAAUGGAGCAGGGGCGCG | 265 | 3 | CGAAUGGAGCAGGGGCGCG | 265 | 25 | CGCGCCCCUGCUCCAUUCG | 465 |
| 21 | GCAGAUAAUUAAAGAUUUA | 266 | 21 | GCAGAUAAUUAAAGAUUUA | 266 | 43 | UAAAUCUUUAAUUAUCUGC | 466 |
| 39 | ACACACAGCUGGAAGAAAU | 267 | 39 | ACACACAGCUGGAAGAAAU | 267 | 61 | AUUUCUUCCAGCUGUGUGU | 467 |
| 57 | UCAUAGAGAAGCCGGGCGU | 268 | 57 | UCAUAGAGAAGCCGGGCGU | 268 | 79 | ACGCCCGGCUUCUCUAUGA | 468 |
| 75 | UGGUGGCUCAUGCCUAUAA | 269 | 75 | UGGUGGCUCAUGCCUAUAA | 269 | 97 | UUAUAGGCAUGAGCCACCA | 469 |
| 93 | AUCCCAGCACUUUGGAGG | 270 | 93 | AUCCCAGCACUUUGGAGG | 270 | 115 | CCUCCAAAAGUGCUGGGAU | 470 |
| 111 | GCUGAGGCGGGCAGAUCAC | 271 | 111 | GCUGAGGCGGGCAGAUCAC | 271 | 133 | GUGAUCUGCCCGCCUCAGC | 471 |
| 129 | CUUGAGAUCAGGAGUUCGA | 272 | 129 | CUUGAGAUCAGGAGUUCGA | 272 | 151 | UCGAACUCCUGAUCUCAAG | 472 |
| 147 | AGACCAGCCUGGUGCCUUG | 273 | 147 | AGACCAGCCUGGUGCCUUG | 273 | 169 | CAAGGCACCAGGCUGGUCU | 473 |
| 165 | GGCAUCUCCCAAUGGGGUG | 274 | 165 | GGCAUCUCCCAAUGGGGUG | 274 | 187 | CACCCCAUUGGGAGAUGCC | 474 |
| 183 | GGCUUUGCUCUGGGCUCCU | 275 | 183 | GGCUUUGCUCUGGGCUCCU | 275 | 205 | AGGAGCCCAGAGCAAAGCC | 475 |
| 201 | UGUCCCGUGAGCUGCCU | 276 | 201 | UGUCCCGUGAGCUGCCU | 276 | 223 | AGGCAGCUCACAGGGAACA | 476 |
| 219 | UGGUCCUGCUGCAGGUGGC | 277 | 219 | UGGUCCUGCUGCAGGUGGC | 277 | 241 | GCCACCUGCAGCAGGACCA | 477 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 237 | CAAGCUCUGGGAACAUGAA | 278 | 237 | CAAGCUCUGGGAACAUGAA | 278 | 259 | UUCAUGUUCCCAGAGCUUG | 478 |
| 255 | AGGUCUUGCAGGAGCCCAC | 279 | 255 | AGGUCUUGCAGGAGCCCAC | 279 | 277 | GUGGGCUCCUGCAAGACCU | 479 |
| 273 | CCUGCGUCCGACUACAU | 280 | 273 | CCUGCGUCCGACUACAU | 280 | 295 | AUGUAGUCGGAGACGCAGG | 480 |
| 291 | UGAGCAUCUCUACUUGCGA | 281 | 291 | UGAGCAUCUCUACUUGCGA | 281 | 313 | UCGCAAGUAGAGAUGCUCA | 481 |
| 309 | AGUGGAAGAUGAAUGGUCC | 282 | 309 | AGUGGAAGAUGAAUGGUCC | 282 | 331 | GGACCAUUCAUCUUCCACU | 482 |
| 327 | CCACCAAUUGCAGCACCGA | 283 | 327 | CCACCAAUUGCAGCACCGA | 283 | 349 | UCGGUGCUGCAAUUGGUGG | 483 |
| 345 | AGCUCCGCCUGUUGUACCA | 284 | 345 | AGCUCCGCCUGUUGUACCA | 284 | 367 | UGGUACAACAGGCGGAGCU | 484 |
| 363 | AGCUGGUUUUCUGCUCUC | 285 | 363 | AGCUGGUUUUCUGCUCUC | 285 | 385 | GAGAGCAGAAAACCAGCU | 485 |
| 381 | CCGAAGCCCACACGUGUAU | 286 | 381 | CCGAAGCCCACACGUGUAU | 286 | 403 | AUACACGUGUGGGCUUCGG | 486 |
| 399 | UCCUGAGAACAACGGAGG | 287 | 399 | UCCUGAGAACAACGGAGG | 287 | 421 | CCUCCGUUGUUCUCAGGGA | 487 |
| 417 | GCGCGGGGUGCGUGUGCCA | 288 | 417 | GCGCGGGGUGCGUGUGCCA | 288 | 439 | UGGCACACGCACCCCGCGC | 488 |
| 435 | ACCUGCUCAUGGAUGACGU | 289 | 435 | ACCUGCUCAUGGAUGACGU | 289 | 457 | ACGUCAUCCAUGAGCAGGU | 489 |
| 453 | UGGUCAGUGCGGAUAACUA | 290 | 453 | UGGUCAGUGCGGAUAACUA | 290 | 475 | UAGUUAUCCGCACUGACCA | 490 |
| 471 | AUACACUGGACCUGUGGGC | 291 | 471 | AUACACUGGACCUGUGGGC | 291 | 493 | GCCCACAGGUCCAGUGUAU | 491 |
| 489 | CUGGGCAGCAGCUGCUGUG | 292 | 489 | CUGGGCAGCAGCUGCUGUG | 292 | 511 | CACAGCAGCUGCUGCCCAG | 492 |
| 507 | GGAAGGGCUCCUUCAAGCC | 293 | 507 | GGAAGGGCUCCUUCAAGCC | 293 | 529 | GGCUUGAAGGAGCCCUUCC | 493 |
| 525 | CCAGCGAGCAUGUGAAACC | 294 | 525 | CCAGCGAGCAUGUGAAACC | 294 | 547 | GGUUUCACAUGCUCGCUGG | 494 |
| 543 | CCAGGGCCCCAGGAAACCU | 295 | 543 | CCAGGGCCCCAGGAAACCU | 295 | 565 | AGGUUUCCUGGGGCCCUGG | 495 |
| 561 | UGACAGUUCACACCAAUGU | 296 | 561 | UGACAGUUCACACCAAUGU | 296 | 583 | ACAUUGGUGUGAACUGUCA | 496 |
| 579 | UCUCCGACACUCUGCUGCU | 297 | 579 | UCUCCGACACUCUGCUGCU | 297 | 601 | AGCAGCAGAGUGUCGGAGA | 497 |
| 597 | UGACCUGGAGCAACCCGUA | 298 | 597 | UGACCUGGAGCAACCCGUA | 298 | 619 | UACGGGUUGCUCCAGGUCA | 498 |
| 615 | AUCCCCUGACAAUUACCU | 299 | 615 | AUCCCCUGACAAUUACCU | 299 | 637 | AGGUAAUUGUCAGGGGAU | 499 |
| 633 | UGUAUAAUCAUCUCACCUA | 300 | 633 | UGUAUAAUCAUCUCACCUA | 300 | 655 | UAGGUGAGAUGAUUAUACA | 500 |
| 651 | AUGCAGUCAACAUUUGGAG | 301 | 651 | AUGCAGUCAACAUUUGGAG | 301 | 673 | CUCCAAAUGUUGACUGCAU | 501 |
| 669 | GUGAAAACGACCCGGCAGA | 302 | 669 | GUGAAAACGACCCGGCAGA | 302 | 691 | UCUGCCGGGUCGUUUUCAC | 502 |
| 687 | AUUUCAGAAUCUAUAACGU | 303 | 687 | AUUUCAGAAUCUAUAACGU | 303 | 709 | ACGUUAUAGAUUCUGAAAU | 503 |
| 705 | UGACCUACCUAGAACCCUC | 304 | 705 | UGACCUACCUAGAACCCUC | 304 | 727 | GAGGGUUCUAGGUAGGUCA | 504 |
| 723 | CCCUCCGCAUCGCAGCCAG | 305 | 723 | CCCUCCGCAUCGCAGCCAG | 305 | 745 | CUGGCUGCGAUGCGGAGGG | 505 |
| 741 | GCACCCUGAAGUCUGGGAU | 306 | 741 | GCACCCUGAAGUCUGGGAU | 306 | 763 | AUCCCAGACUUCAGGGUGC | 506 |
| 759 | UUUCCUACAGGGCACGGGU | 307 | 759 | UUUCCUACAGGGCACGGGU | 307 | 781 | ACCCGUGCCCUGUAGGAAA | 507 |
| 777 | UGAGGGCCUGGGCUCAGUG | 308 | 777 | UGAGGGCCUGGGCUCAGUG | 308 | 799 | CACUGAGCCCAGGCCCUCA | 508 |
| 795 | GCUAUAACACCACCUGGAG | 309 | 795 | GCUAUAACACCACCUGGAG | 309 | 817 | CUCCAGGUGGUGUUAUAGC | 509 |
| 813 | GUGAGUGGAGCCCCAGCAC | 310 | 813 | GUGAGUGGAGCCCCAGCAC | 310 | 835 | GUGCUGGGGCUCCACUCAC | 510 |
| 831 | CCAAGUGGCACAACUCCUA | 311 | 831 | CCAAGUGGCACAACUCCUA | 311 | 853 | UAGGAGUUGUGCCACUUGG | 511 |
| 849 | ACAGGGAGCCCUUCGAGCA | 312 | 849 | ACAGGGAGCCCUUCGAGCA | 312 | 871 | UGCUCGAAGGGCUCCCUGU | 512 |
| 867 | AGCACCUCCUGCUGGGCGU | 313 | 867 | AGCACCUCCUGCUGGGCGU | 313 | 889 | ACGCCCAGCAGGAGGUGCU | 513 |
| 885 | UCAGCGUUCCUGCAUUGU | 314 | 885 | UCAGCGUUCCUGCAUUGU | 314 | 907 | ACAAUGCAGGAAACGCUGA | 514 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 903 | UCAUCCUGGCCGUCUGCCU | 315 | 903 | UCAUCCUGGCCGUCUGCCU | 315 | 925 | AGGCAGACGGCCAGGAUGA | 515 |
| 921 | UGUUGUGCUAUGUCAGCAU | 316 | 921 | UGUUGUGCUAUGUCAGCAU | 316 | 943 | AUGCUGACAUAGCACAACA | 516 |
| 939 | UCACCAAGAUUAAGAAAGA | 317 | 939 | UCACCAAGAUUAAGAAAGA | 317 | 961 | UCUUUCUUAAUCUUGGUGA | 517 |
| 957 | AAUGGUGGGAUCAGAUUCC | 318 | 957 | AAUGGUGGGAUCAGAUUCC | 318 | 979 | GGAAUCUGAUCCCACCAUU | 518 |
| 975 | CCAACCCAGCCCGCAGCCG | 319 | 975 | CCAACCCAGCCCGCAGCCG | 319 | 997 | CGGCUGCGGGCUGGGUUGG | 519 |
| 993 | GCCUCGUGGCUAUAAUAAU | 320 | 993 | GCCUCGUGGCUAUAAUAAU | 320 | 1015 | AUUAUUAUAGCCACGAGGC | 520 |
| 1011 | UCCAGGAUGCUCAGGGGUC | 321 | 1011 | UCCAGGAUGCUCAGGGGUC | 321 | 1033 | GACCCCUGAGCAUCCUGGA | 521 |
| 1029 | CACAGUGGGAGAAGCGGUC | 322 | 1029 | CACAGUGGGAGAAGCGGUC | 322 | 1051 | GACCGCUUCUCCCACUGUG | 522 |
| 1047 | CCCGAGGCCAGGAACCAGC | 323 | 1047 | CCCGAGGCCAGGAACCAGC | 323 | 1069 | GCUGGUUCCUGGCCUCGGG | 523 |
| 1065 | CCAAGUGCCCACACUGGAA | 324 | 1065 | CCAAGUGCCCACACUGGAA | 324 | 1087 | UUCCAGUGUGGGCACUUGG | 524 |
| 1083 | AGAAUUGUCUUACCAAGCU | 325 | 1083 | AGAAUUGUCUUACCAAGCU | 325 | 1105 | AGCUUGGUAAGACAAUUCU | 525 |
| 1101 | UCUUGCCCUGUUUUCUGGA | 326 | 1101 | UCUUGCCCUGUUUUCUGGA | 326 | 1123 | UCCAGAAAACAGGGCAAGA | 526 |
| 1119 | AGCACAACAUGAAAAGGGA | 327 | 1119 | AGCACAACAUGAAAAGGGA | 327 | 1141 | UCCCUUUUCAUGUUGUGCU | 527 |
| 1137 | AUGAAGAUCCUCACAAGGC | 328 | 1137 | AUGAAGAUCCUCACAAGGC | 328 | 1159 | GCCUUGUGAGGAUCUUCAU | 528 |
| 1155 | CUGCCAAAGAGAUGCCUUU | 329 | 1155 | CUGCCAAAGAGAUGCCUUU | 329 | 1177 | AAAGGCAUCUCUUUGGCAG | 529 |
| 1173 | UCCAGGGCUCUGGAAAAUC | 330 | 1173 | UCCAGGGCUCUGGAAAAUC | 330 | 1195 | GAUUUUCCAGAGCCCUGGA | 530 |
| 1191 | CAGCAUGGUGCCCAGUGGA | 331 | 1191 | CAGCAUGGUGCCCAGUGGA | 331 | 1213 | UCCACUGGGCACCAUGCUG | 531 |
| 1209 | AGAUCAGCAAGACAGUCCU | 332 | 1209 | AGAUCAGCAAGACAGUCCU | 332 | 1231 | AGGACUGUCUUGCUGAUCU | 532 |
| 1227 | UCUGGCCAGAGAGCAUCAG | 333 | 1227 | UCUGGCCAGAGAGCAUCAG | 333 | 1249 | CUGAUGCUCUCUGGCCAGA | 533 |
| 1245 | GCGUGGUGCGAUGUGUGGA | 334 | 1245 | GCGUGGUGCGAUGUGUGGA | 334 | 1267 | UCCACACAUCGCACCACGC | 534 |
| 1263 | AGUUGUUUGAGGCCCCGGU | 335 | 1263 | AGUUGUUUGAGGCCCCGGU | 335 | 1285 | ACCGGGGCCUCAAACAACU | 535 |
| 1281 | UGGAGUGUGAGGAGGAGGA | 336 | 1281 | UGGAGUGUGAGGAGGAGGA | 336 | 1303 | UCCUCCUCCUCACACUCCA | 536 |
| 1299 | AGGAGGUAGAGGAAGAAAA | 337 | 1299 | AGGAGGUAGAGGAAGAAAA | 337 | 1321 | UUUUCUUCCUCUACCUCCU | 537 |
| 1317 | AAGGGAGCUUCUGUGCAUC | 338 | 1317 | AAGGGAGCUUCUGUGCAUC | 338 | 1339 | GAUGCACAGAAGCUCCCUU | 538 |
| 1335 | CGCCUGAGAGCAGCAGGGA | 339 | 1335 | CGCCUGAGAGCAGCAGGGA | 339 | 1357 | UCCCUGCUGCUCUCAGGCG | 539 |
| 1353 | AUGACUUCCAGGAGGGAAG | 340 | 1353 | AUGACUUCCAGGAGGGAAG | 340 | 1375 | CUUCCCUCCUGGAAGUCAU | 540 |
| 1371 | GGGAGGGCAUUGUGGCCCG | 341 | 1371 | GGGAGGGCAUUGUGGCCCG | 341 | 1393 | CGGGCCACAAUGCCCUCCC | 541 |
| 1389 | GGCUAACAGAGAGCCUGUU | 342 | 1389 | GGCUAACAGAGAGCCUGUU | 342 | 1411 | AACAGGCUCUCUGUUAGCC | 542 |
| 1407 | UCCUGGACCUGCUCGGAGA | 343 | 1407 | UCCUGGACCUGCUCGGAGA | 343 | 1429 | UCUCCGAGCAGGUCCAGGA | 543 |
| 1425 | AGGAGAAUGGGGGCUUUUG | 344 | 1425 | AGGAGAAUGGGGGCUUUUG | 344 | 1447 | CAAAAGCCCCCAUUCUCCU | 544 |
| 1443 | GCCAGCAGGACAUGGGGA | 345 | 1443 | GCCAGCAGGACAUGGGGA | 345 | 1465 | UCCCCCAUGUCCUGCUGGC | 545 |
| 1461 | AGUCAUGCCUUCUUCCACC | 346 | 1461 | AGUCAUGCCUUCUUCCACC | 346 | 1483 | GGUGGAAGAAGGCAUGACU | 546 |
| 1479 | CUUCGGGAAGUACGAGUGC | 347 | 1479 | CUUCGGGAAGUACGAGUGC | 347 | 1501 | GCACUCGUACUUCCCGAAG | 547 |
| 1497 | CUCACAUGCCCUGGGAUGA | 348 | 1497 | CUCACAUGCCCUGGGAUGA | 348 | 1519 | UCAUCCAGGGCAUGUGAG | 548 |
| 1515 | AGUUCCCAAGUGCAGGGCC | 349 | 1515 | AGUUCCCAAGUGCAGGGCC | 349 | 1537 | GGCCCUGCACUUGGGAACU | 549 |
| 1533 | CCAAGGAGGCACCUCCCUG | 350 | 1533 | CCAAGGAGGCACCUCCCUG | 350 | 1555 | CAGGGAGGUGCCUCCUUGG | 550 |
| 1551 | GGGGCAAGGAGCAGCCUCU | 351 | 1551 | GGGGCAAGGAGCAGCCUCU | 351 | 1573 | AGAGGCUGCUCCUUGCCCC | 551 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 1569 | UCCACCUGGAGCCAAGUCC | 352 | 1569 | UCCACCUGGAGCCAAGUCC | 352 | 1591 | GGACUUGGCUCCAGGUGGA | 552 |
| 1587 | CUCCUGCCAGCCCGACCCA | 353 | 1587 | CUCCUGCCAGCCCGACCCA | 353 | 1609 | UGGGUCGGGCUGGCAGGAG | 553 |
| 1605 | AGAGUCCAGACAACCUGAC | 354 | 1605 | AGAGUCCAGACAACCUGAC | 354 | 1627 | GUCAGGUUGUCUGGACUCU | 554 |
| 1623 | CUUGCACAGAGACGCCCU | 355 | 1623 | CUUGCACAGAGACGCCCU | 355 | 1645 | AGGGGCGUCUCUGUGCAAG | 555 |
| 1641 | UCGUCAUCGCAGGCAACCC | 356 | 1641 | UCGUCAUCGCAGGCAACCC | 356 | 1663 | GGGUUGCCUGCGAUGACGA | 556 |
| 1659 | CUGCUUACCGCAGCUUCAG | 357 | 1659 | CUGCUUACCGCAGCUUCAG | 357 | 1681 | CUGAAGCUGCGGUAAGCAG | 557 |
| 1677 | GCAACUCCCUGAGCCAGUC | 358 | 1677 | GCAACUCCCUGAGCCAGUC | 358 | 1699 | GACUGGCUCAGGGAGUUGC | 558 |
| 1695 | CACCGUGUCCCAGAGAGCU | 359 | 1695 | CACCGUGUCCCAGAGAGCU | 359 | 1717 | AGCUCUCUGGGACACGGUG | 559 |
| 1713 | UGGGUCCAGACCCACUGCU | 360 | 1713 | UGGGUCCAGACCCACUGCU | 360 | 1735 | AGCAGUGGGUCUGGACCCA | 560 |
| 1731 | UGGCCAGACACCUGGAGGA | 361 | 1731 | UGGCCAGACACCUGGAGGA | 361 | 1753 | UCCUCCAGGUGUCUGGCCA | 561 |
| 1749 | AAGUAGAACCCGAGAUGCC | 362 | 1749 | AAGUAGAACCCGAGAUGCC | 362 | 1771 | GGCAUCUCGGGUUCUACUU | 562 |
| 1767 | CCUGUGUCCCCAGCUCUC | 363 | 1767 | CCUGUGUCCCCAGCUCUC | 363 | 1789 | GAGAGCUGGGGACACAGG | 563 |
| 1785 | CUGAGCCAACCACUGUGCC | 364 | 1785 | CUGAGCCAACCACUGUGCC | 364 | 1807 | GGCACAGUGGUUGGCUCAG | 564 |
| 1803 | CCCAACCUGAGCCAGAAAC | 365 | 1803 | CCCAACCUGAGCCAGAAAC | 365 | 1825 | GUUUCUGGCUCAGGUUGGG | 565 |
| 1821 | CCUGGGAGCAGAUCCUCCG | 366 | 1821 | CCUGGGAGCAGAUCCUCCG | 366 | 1843 | CGGAGGAUCUGCUCCCAGG | 566 |
| 1839 | GCCGAAAUGUCCUCCAGCA | 367 | 1839 | GCCGAAAUGUCCUCCAGCA | 367 | 1861 | UGCUGGAGGACAUUUCGGC | 567 |
| 1857 | AUGGGGCAGCUGCAGCCCC | 368 | 1857 | AUGGGGCAGCUGCAGCCCC | 368 | 1879 | GGGGCUGCAGCUGCCCCAU | 568 |
| 1875 | CCGUCUCGGCCCCCACCAG | 369 | 1875 | CCGUCUCGGCCCCCACCAG | 369 | 1897 | CUGGUGGGGCCGAGACGG | 569 |
| 1893 | GUGGCUAUCAGGAGUUUGU | 370 | 1893 | GUGGCUAUCAGGAGUUUGU | 370 | 1915 | ACAAACUCCUGAUAGCCAC | 570 |
| 1911 | UACAUGCGGUGGAGCAGGG | 371 | 1911 | UACAUGCGGUGGAGCAGGG | 371 | 1933 | CCCUGCUCCACCGCAUGUA | 571 |
| 1929 | GUGGCACCCAGGCCAGUGC | 372 | 1929 | GUGGCACCCAGGCCAGUGC | 372 | 1951 | GCACUGGCCUGGGUGCCAC | 572 |
| 1947 | CGGUGGUGGGCUUGGGUCC | 373 | 1947 | CGGUGGUGGGCUUGGGUCC | 373 | 1969 | GGACCCAAGCCCACCACCG | 573 |
| 1965 | CCCCAGGAGAGGCUGGUUA | 374 | 1965 | CCCCAGGAGAGGCUGGUUA | 374 | 1987 | UAACCAGCCUCUCCUGGGG | 574 |
| 1983 | ACAAGGCCUUCUCAAGCCU | 375 | 1983 | ACAAGGCCUUCUCAAGCCU | 375 | 2005 | AGGCUUGAGAAGGCCUUGU | 575 |
| 2001 | UGCUUGCCAGCAGUGCUGU | 376 | 2001 | UGCUUGCCAGCAGUGCUGU | 376 | 2023 | ACAGCACUGCUGGCAAGCA | 576 |
| 2019 | UGUCCCAGAGAAAUGUGG | 377 | 2019 | UGUCCCAGAGAAAUGUGG | 377 | 2041 | CCACAUUUCUCUGGGGACA | 577 |
| 2037 | GGUUUGGGGCUAGCAGUGG | 378 | 2037 | GGUUUGGGGCUAGCAGUGG | 378 | 2059 | CCACUGCUAGCCCCAAACC | 578 |
| 2055 | GGGAAGAGGGGUAUAAGCC | 379 | 2055 | GGGAAGAGGGGUAUAAGCC | 379 | 2077 | GGCUUAUACCCCUCUUCCC | 579 |
| 2073 | CUUUCCAAGACCUCAUUCC | 380 | 2073 | CUUUCCAAGACCUCAUUCC | 380 | 2095 | GGAAUGAGGUCUUGGAAAG | 580 |
| 2091 | CUGGCUGCCCUGGGGACCC | 381 | 2091 | CUGGCUGCCCUGGGGACCC | 381 | 2113 | GGGUCCCCAGGGCAGCCAG | 581 |
| 2109 | CUGCCCCAGUCCCUGUCCC | 382 | 2109 | CUGCCCCAGUCCCUGUCCC | 382 | 2131 | GGGACAGGGACUGGGGCAG | 582 |
| 2127 | CCUUGUUCACCUUUGGACU | 383 | 2127 | CCUUGUUCACCUUUGGACU | 383 | 2149 | AGUCCAAAGGUGAACAAGG | 583 |
| 2145 | UGGACAGGGAGCCACCUCG | 384 | 2145 | UGGACAGGGAGCCACCUCG | 384 | 2167 | CGAGGUGGCUCCCUGUCCA | 584 |
| 2163 | GCAGUCCGCAGAGCUCACA | 385 | 2163 | GCAGUCCGCAGAGCUCACA | 385 | 2185 | UGUGAGCUCUGCGGACUGC | 585 |
| 2181 | AUCUCCCAAGCAGCUCCCC | 386 | 2181 | AUCUCCCAAGCAGCUCCCC | 386 | 2203 | GGGGAGCUGCUUGGGAGAU | 586 |
| 2199 | CAGAGCACCUGGGUCUGGA | 387 | 2199 | CAGAGCACCUGGGUCUGGA | 387 | 2221 | UCCAGACCCAGGUGCUCUG | 587 |
| 2217 | AGCCGGGGGAAAAGGUAGA | 388 | 2217 | AGCCGGGGGAAAAGGUAGA | 388 | 2239 | UCUACCUUUUCCCCCGGCU | 588 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 2235 | AGGACAUGCCAAAGCCCCC | 389 | 2235 | AGGACAUGCCAAAGCCCCC | 389 | 2257 | GGGGGCUUUGGCAUGUCCU | 589 |
| 2253 | CACUUCCCAGGAGCAGGC | 390 | 2253 | CACUUCCCAGGAGCAGGC | 390 | 2275 | GCCUGCUCCUGGGGAAGUG | 590 |
| 2271 | CCACAGACCCCUUGUGGA | 391 | 2271 | CCACAGACCCCUUGUGGA | 391 | 2293 | UCCACAAGGGGGUCUGUGG | 591 |
| 2289 | ACAGCCUGGGCAGUGGCAU | 392 | 2289 | ACAGCCUGGGCAGUGGCAU | 392 | 2311 | AUGCCACUGCCCAGGCUGU | 592 |
| 2307 | UUGUCUACUCAGCCCUUAC | 393 | 2307 | UUGUCUACUCAGCCCUUAC | 393 | 2329 | GUAAGGGCUGAGUAGACAA | 593 |
| 2325 | CCUGCCACCUGUGCGGCA | 394 | 2325 | CCUGCCACCUGUGCGGCA | 394 | 2347 | UGGCCGCACAGGUGGCAGG | 594 |
| 2343 | ACCUGAAACAGUGUCAUGG | 395 | 2343 | ACCUGAAACAGUGUCAUGG | 395 | 2365 | CCAUGACACUGUUUCAGGU | 595 |
| 2361 | GCCAGGAGGAUGGUGGCCA | 396 | 2361 | GCCAGGAGGAUGGUGGCCA | 396 | 2383 | UGGCCACCAUCCUCCUGGC | 596 |
| 2379 | AGACCCUGUCAUGGCCAG | 397 | 2379 | AGACCCUGUCAUGGCCAG | 397 | 2401 | CUGGCCAUGACAGGGGUCU | 597 |
| 2397 | GUCCUUGCUGUGGCUGCUG | 398 | 2397 | GUCCUUGCUGUGGCUGCUG | 398 | 2419 | CAGCAGCCACAGCAAGGAC | 598 |
| 2415 | GCUGUGGAGACAGGUCCUC | 399 | 2415 | GCUGUGGAGACAGGUCCUC | 399 | 2437 | GAGGACCUGUCUCCACAGC | 599 |
| 2433 | CGCCCCUACAACCCCCU | 400 | 2433 | CGCCCCUACAACCCCCU | 400 | 2455 | AGGGGGGUUGUAGGGGCG | 600 |
| 2451 | UGAGGGCCCCAGACCCCUC | 401 | 2451 | UGAGGGCCCCAGACCCCUC | 401 | 2473 | GAGGGGUCUGGGGCCCUCA | 601 |
| 2469 | CUCCAGGUGGGGUUCCACU | 402 | 2469 | CUCCAGGUGGGGUUCCACU | 402 | 2491 | AGUGGAACCCCACCUGGAG | 602 |
| 2487 | UGGAGGCCAGUCUGUGUCC | 403 | 2487 | UGGAGGCCAGUCUGUGUCC | 403 | 2509 | GGACACAGACUGGCCUCCA | 603 |
| 2505 | CGGCCUCCCUGGCACCCUC | 404 | 2505 | CGGCCUCCCUGGCACCCUC | 404 | 2527 | GAGGGUGCCAGGGAGGCCG | 604 |
| 2523 | CGGGCAUCUCAGAGAAGAG | 405 | 2523 | CGGGCAUCUCAGAGAAGAG | 405 | 2545 | CUCUUCUCUGAGAUGCCCG | 605 |
| 2541 | GUAAAUCCUCAUCAUCCUU | 406 | 2541 | GUAAAUCCUCAUCAUCCUU | 406 | 2563 | AAGGAUGAUGAGGAUUUAC | 606 |
| 2559 | UCCAUCCUGCCCCUGGCAA | 407 | 2559 | UCCAUCCUGCCCCUGGCAA | 407 | 2581 | UUGCCAGGGGCAGGAUGGA | 607 |
| 2577 | AUGCUCAGAGCUCAAGCCA | 408 | 2577 | AUGCUCAGAGCUCAAGCCA | 408 | 2599 | UGGCUUGAGCUCUGAGCAU | 608 |
| 2595 | AGACCCCCAAAAUCGUGAA | 409 | 2595 | AGACCCCCAAAAUCGUGAA | 409 | 2617 | UUCACGAUUUUGGGGGUCU | 609 |
| 2613 | ACUUUGUCUCCGUGGGACC | 410 | 2613 | ACUUUGUCUCCGUGGGACC | 410 | 2635 | GGUCCCACGGAGACAAAGU | 610 |
| 2631 | CCACAUACAUGAGGGUCUC | 411 | 2631 | CCACAUACAUGAGGGUCUC | 411 | 2653 | GAGACCCUCAUGUAUGUGG | 611 |
| 2649 | CUUAGGUGCAUGUCCUCUU | 412 | 2649 | CUUAGGUGCAUGUCCUCUU | 412 | 2671 | AAGAGGACAUGCACCUAAG | 612 |
| 2667 | UGUUGCUGAGUCUGCAGAU | 413 | 2667 | UGUUGCUGAGUCUGCAGAU | 413 | 2689 | AUCUGCAGACUCAGCAACA | 613 |
| 2685 | UGAGGACUAGGGCUUAUCC | 414 | 2685 | UGAGGACUAGGGCUUAUCC | 414 | 2707 | GGAUAAGCCCUAGUCCUCA | 614 |
| 2703 | CAUGCCUGGGAAAUGCCAC | 415 | 2703 | CAUGCCUGGGAAAUGCCAC | 415 | 2725 | GUGGCAUUUCCCAGGCAUG | 615 |
| 2721 | CCUCCUGGAAGGCAGCCAG | 416 | 2721 | CCUCCUGGAAGGCAGCCAG | 416 | 2743 | CUGGCUGCCUUCCAGGAGG | 616 |
| 2739 | GGCUGGCAGAUUUCCAAAA | 417 | 2739 | GGCUGGCAGAUUUCCAAAA | 417 | 2761 | UUUUGGAAAUCUGCCAGCC | 617 |
| 2757 | AGACUUGAAGAACCAUGGU | 418 | 2757 | AGACUUGAAGAACCAUGGU | 418 | 2779 | ACCAUGGUUCUUCAAGUCU | 618 |
| 2775 | UAUGAAGGUGAUUGGCCCC | 419 | 2775 | UAUGAAGGUGAUUGGCCCC | 419 | 2797 | GGGGCCAAUCACCUUCAUA | 619 |
| 2793 | CACUGACGUUGGCCUAACA | 420 | 2793 | CACUGACGUUGGCCUAACA | 420 | 2815 | UGUUAGGCCAACGUCAGUG | 620 |
| 2811 | ACUGGGCUGCAGAGACUGG | 421 | 2811 | ACUGGGCUGCAGAGACUGG | 421 | 2833 | CCAGUCUCUGCAGCCCAGU | 621 |
| 2829 | GACCCCGCCCAGCAUUGGG | 422 | 2829 | GACCCCGCCCAGCAUUGGG | 422 | 2851 | CCCAAUGCUGGGCGGGGUC | 622 |
| 2847 | GCUGGGCUCGCCACAUCCC | 423 | 2847 | GCUGGGCUCGCCACAUCCC | 423 | 2869 | GGGAUGUGGCGAGCCCAGC | 623 |
| 2865 | CAUGAGAGUAGAGGGCACU | 424 | 2865 | CAUGAGAGUAGAGGGCACU | 424 | 2887 | AGUGCCCUCUACUCUCAUG | 624 |
| 2883 | UGGGUCGCCGUGCCCCACG | 425 | 2883 | UGGGUCGCCGUGCCCCACG | 425 | 2905 | CGUGGGGCACGGCGACCCA | 625 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 2901 | GGCAGGCCCCUGCAGGAAA | 426 | 2901 | GGCAGGCCCCUGCAGGAAA | 426 | 2923 | UUUCCUGCAGGGGCCUGCC | 626 |
| 2919 | AACUGAGGCCCUUGGGCAC | 427 | 2919 | AACUGAGGCCCUUGGGCAC | 427 | 2941 | GUGCCCAAGGGCCUCAGUU | 627 |
| 2937 | CCUCGACUUGUGAACGAGU | 428 | 2937 | CCUCGACUUGUGAACGAGU | 428 | 2959 | ACUCGUUCACAAGUCGAGG | 628 |
| 2955 | UUGUUGGCUGCUCCCUCCA | 429 | 2955 | UUGUUGGCUGCUCCCUCCA | 429 | 2977 | UGGAGGGAGCAGCCAACAA | 629 |
| 2973 | ACAGCUUCUGCAGCAGACU | 430 | 2973 | ACAGCUUCUGCAGCAGACU | 430 | 2995 | AGUCUGCUGCAGAAGCUGU | 630 |
| 2991 | UGUCCCUGUUGUAACUGCC | 431 | 2991 | UGUCCCUGUUGUAACUGCC | 431 | 3013 | GGCAGUUACAACAGGGACA | 631 |
| 3009 | CCAAGGCAUGUUUUGCCCA | 432 | 3009 | CCAAGGCAUGUUUUGCCCA | 432 | 3031 | UGGGCAAAACAUGCCUUGG | 632 |
| 3027 | ACCAGAUCAUGGCCCACGU | 433 | 3027 | ACCAGAUCAUGGCCCACGU | 433 | 3049 | ACGUGGGCCAUGAUCUGGU | 633 |
| 3045 | UGGAGGCCCACCUGCCUCU | 434 | 3045 | UGGAGGCCCACCUGCCUCU | 434 | 3067 | AGAGGCAGGUGGGCCUCCA | 634 |
| 3063 | UGUCUCACUGAACUAGAAG | 435 | 3063 | UGUCUCACUGAACUAGAAG | 435 | 3085 | CUUCUAGUUCAGUGAGACA | 635 |
| 3081 | GCCGAGCCUAGAAACUAAC | 436 | 3081 | GCCGAGCCUAGAAACUAAC | 436 | 3103 | GUUAGUUUCUAGGCUCGGC | 636 |
| 3099 | CACAGCCAUCAAGGGAAUG | 437 | 3099 | CACAGCCAUCAAGGGAAUG | 437 | 3121 | CAUUCCCUUGAUGGCUGUG | 637 |
| 3117 | GACUUGGGCGGCCUUGGGA | 438 | 3117 | GACUUGGGCGGCCUUGGGA | 438 | 3139 | UCCCAAGGCCGCCCAAGUC | 638 |
| 3135 | AAAUCGAUGAGAAAUUGAA | 439 | 3135 | AAAUCGAUGAGAAAUUGAA | 439 | 3157 | UUCAAUUUCUCAUCGAUUU | 639 |
| 3153 | ACUUCAGGGAGGGUGGUCA | 440 | 3153 | ACUUCAGGGAGGGUGGUCA | 440 | 3175 | UGACCACCCUCCCUGAAGU | 640 |
| 3171 | AUUGCCUAGAGGUGCUCAU | 441 | 3171 | AUUGCCUAGAGGUGCUCAU | 441 | 3193 | AUGAGCACCUCUAGGCAAU | 641 |
| 3189 | UUCAUUUAACAGAGCUUCC | 442 | 3189 | UUCAUUUAACAGAGCUUCC | 442 | 3211 | GGAAGCUCUGUUAAAUGAA | 642 |
| 3207 | CUUAGGUUGAUGCUGGAGG | 443 | 3207 | CUUAGGUUGAUGCUGGAGG | 443 | 3229 | CCUCCAGCAUCAACCUAAG | 643 |
| 3225 | GCAGAAUCCCGGCUGUCAA | 444 | 3225 | GCAGAAUCCCGGCUGUCAA | 444 | 3247 | UUGACAGCCGGGAUUCUGC | 644 |
| 3243 | AGGGGUGUUCAGUUAAGGG | 445 | 3243 | AGGGGUGUUCAGUUAAGGG | 445 | 3265 | CCCUUAACUGAACACCCCU | 645 |
| 3261 | GGAGCAACAGAGGACAUGA | 446 | 3261 | GGAGCAACAGAGGACAUGA | 446 | 3283 | UCAUGUCCUCUGUUGCUCC | 646 |
| 3279 | AAAAAUUGCUAUGACUAAA | 447 | 3279 | AAAAAUUGCUAUGACUAAA | 447 | 3301 | UUUAGUCAUAGCAAUUUUU | 647 |
| 3297 | AGCAGGGACAAUUUGCUGC | 448 | 3297 | AGCAGGGACAAUUUGCUGC | 448 | 3319 | GCAGCAAAUUGUCCCUGCU | 648 |
| 3315 | CCAAACACCCAUGCCCAGC | 449 | 3315 | CCAAACACCCAUGCCCAGC | 449 | 3337 | GCUGGGCAUGGGUGUUUGG | 649 |
| 3333 | CUGUAUGGCUGGGGGCUCC | 450 | 3333 | CUGUAUGGCUGGGGGCUCC | 450 | 3355 | GGAGCCCCAGCCAUACAG | 650 |
| 3351 | CUCGUAUGCAUGGAACCCC | 451 | 3351 | CUCGUAUGCAUGGAACCCC | 451 | 3373 | GGGGUUCCAUGCAUACGAG | 651 |
| 3369 | CCAGAAUAAAUAUGCUCAG | 452 | 3369 | CCAGAAUAAAUAUGCUCAG | 452 | 3391 | CUGAGCAUAUUUAUUCUGG | 652 |
| 3387 | GCCACCCUGUGGGCCGGGC | 453 | 3387 | GCCACCCUGUGGGCCGGGC | 453 | 3409 | GCCCGGCCCACAGGGUGGC | 653 |
| 3405 | CAAUCCAGACAGCAGGCAU | 454 | 3405 | CAAUCCAGACAGCAGGCAU | 454 | 3427 | AUGCCUGCUGUCUGGAUUG | 654 |
| 3423 | UAAGGCACCAGUUACCCUG | 455 | 3423 | UAAGGCACCAGUUACCCUG | 455 | 3445 | CAGGGUAACUGGUGCCUUA | 655 |
| 3441 | GCAUGUUGGCCCAGACCUC | 456 | 3441 | GCAUGUUGGCCCAGACCUC | 456 | 3463 | GAGGUCUGGGCCAACAUGC | 656 |
| 3459 | CAGGUGCUAGGGAAGGCGG | 457 | 3459 | CAGGUGCUAGGGAAGGCGG | 457 | 3481 | CCGCCUUCCCUAGCACCUG | 657 |
| 3477 | GGAACCUUGGGUUGAGUAA | 458 | 3477 | GGAACCUUGGGUUGAGUAA | 458 | 3499 | UUACUCAACCCAAGGUUCC | 658 |
| 3495 | AUGCUCGUCUGUGUGUUUU | 459 | 3495 | AUGCUCGUCUGUGUGUUUU | 459 | 3517 | AAAACACAGACGAGCAU | 659 |
| 3513 | UAGUUUCAUCACCUGUUAU | 460 | 3513 | UAGUUUCAUCACCUGUUAU | 460 | 3535 | AUAACAGGUGAUGAAACUA | 660 |
| 3531 | UCUGUGUUUGCUGAGGAGA | 461 | 3531 | UCUGUGUUUGCUGAGGAGA | 461 | 3553 | UCUCCUCAGCAAACACAGA | 661 |
| 3549 | AGUGGAACAGAAGGGGUGG | 462 | 3549 | AGUGGAACAGAAGGGGUGG | 462 | 3571 | CCACCCCUUCUGUUCCACU | 662 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 3567 | GAGUUUUGUAUAAAUAAAG | 463 | 3567 | GAGUUUUGUAUAAAUAAAG | 463 | 3589 | CUUUAUUUAUACAAAACUC | 663 |
| 3577 | UAAAUAAAGUUUCUUUGUC | 464 | 3577 | UAAAUAAAGUUUCUUUGUC | 464 | 3599 | GACAAAGAAACUUUAUUUA | 664 |

IL13 NM_002188

| Pos | Seq | Seq ID | UPos | Upper seq | Seq ID | LPos | Lower seq | Seq ID |
|---|---|---|---|---|---|---|---|---|
| 3 | GCCACCCAGCCUAUGCAUC | 665 | 3 | GCCACCCAGCCUAUGCAUC | 665 | 25 | GAUGCAUAGGCUGGGUGGC | 736 |
| 21 | CCGCUCCUCAAUCCUCUCC | 666 | 21 | CCGCUCCUCAAUCCUCUCC | 666 | 43 | GGAGAGGAUUGAGGAGCGG | 737 |
| 39 | CUGUUGGCACUGGGCCUCA | 667 | 39 | CUGUUGGCACUGGGCCUCA | 667 | 61 | UGAGGCCCAGUGCCAACAG | 738 |
| 57 | AUGGCGCUUUUGUUGACCA | 668 | 57 | AUGGCGCUUUUGUUGACCA | 668 | 79 | UGGUCAACAAAAGCGCCAU | 739 |
| 75 | ACGGUCAUUGCUCUCACUU | 669 | 75 | ACGGUCAUUGCUCUCACUU | 669 | 97 | AAGUGAGAGCAAUGACCGU | 740 |
| 93 | UGCCUUGGCGGCUUUGCCU | 670 | 93 | UGCCUUGGCGGCUUUGCCU | 670 | 115 | AGGCAAAGCCGCCAAGGCA | 741 |
| 111 | UCCCCAGGCCCUGUGCCUC | 671 | 111 | UCCCCAGGCCCUGUGCCUC | 671 | 133 | GAGGCACAGGGCCUGGGGA | 742 |
| 129 | CCCUCUACAGCCCUCAGGG | 672 | 129 | CCCUCUACAGCCCUCAGGG | 672 | 151 | CCCUGAGGGCUGUAGAGGG | 743 |
| 147 | GAGCUCAUUGAGGAGCUGG | 673 | 147 | GAGCUCAUUGAGGAGCUGG | 673 | 169 | CCAGCUCCUCAAUGAGCUC | 744 |
| 165 | GUCAACAUCACCCAGAACC | 674 | 165 | GUCAACAUCACCCAGAACC | 674 | 187 | GGUUCUGGGUGAUGUUGAC | 745 |
| 183 | CAGAAGGCUCCGCUCUGCA | 675 | 183 | CAGAAGGCUCCGCUCUGCA | 675 | 205 | UGCAGAGCGGAGCCUUCUG | 746 |
| 201 | AAUGGCAGCAUGGUAUGGA | 676 | 201 | AAUGGCAGCAUGGUAUGGA | 676 | 223 | UCCAUACCAUGCUGCCAUU | 747 |
| 219 | AGCAUCAACCUGACAGCUG | 677 | 219 | AGCAUCAACCUGACAGCUG | 677 | 241 | CAGCUGUCAGGUUGAUGCU | 748 |
| 237 | GGCAUGUACUGUGCAGCCC | 678 | 237 | GGCAUGUACUGUGCAGCCC | 678 | 259 | GGGCUGCACAGUACAUGCC | 749 |
| 255 | CUGGAAUCCCUGAUCAACG | 679 | 255 | CUGGAAUCCCUGAUCAACG | 679 | 277 | CGUUGAUCAGGGAUUCCAG | 750 |
| 273 | GUGUCAGGCUGCAGUGCCA | 680 | 273 | GUGUCAGGCUGCAGUGCCA | 680 | 295 | UGGCACUGCAGCCUGACAC | 751 |
| 291 | AUCGAGAAGACCCAGAGGA | 681 | 291 | AUCGAGAAGACCCAGAGGA | 681 | 313 | UCCUCUGGGUCUUCUCGAU | 752 |
| 309 | AUGCUGAGCGGAUUCUGCC | 682 | 309 | AUGCUGAGCGGAUUCUGCC | 682 | 331 | GGCAGAAUCCGCUCAGCAU | 753 |
| 327 | CCGCACAAGGUCUCAGCUG | 683 | 327 | CCGCACAAGGUCUCAGCUG | 683 | 349 | CAGCUGAGACCUUGUGCGG | 754 |
| 345 | GGGCAGUUUUCCAGCUUGC | 684 | 345 | GGGCAGUUUUCCAGCUUGC | 684 | 367 | GCAAGCUGGAAAACUGCCC | 755 |
| 363 | CAUGUCCGAGACACCAAAA | 685 | 363 | CAUGUCCGAGACACCAAAA | 685 | 385 | UUUUGGUGUCUCGGACAUG | 756 |
| 381 | AUCGAGGUGGCCCAGUUUG | 686 | 381 | AUCGAGGUGGCCCAGUUUG | 686 | 403 | CAAACUGGGCCACCUCGAU | 757 |
| 399 | GUAAAGGACCUGCUCUUAC | 687 | 399 | GUAAAGGACCUGCUCUUAC | 687 | 421 | GUAAGAGCAGGUCCUUUAC | 758 |
| 417 | CAUUUAAAGAAACUUUUUC | 688 | 417 | CAUUUAAAGAAACUUUUUC | 688 | 439 | GAAAAAGUUUCUUUAAAUG | 759 |
| 435 | CGCGAGGGACAGUUCAACU | 689 | 435 | CGCGAGGGACAGUUCAACU | 689 | 457 | AGUUGAACUGUCCCUCGCG | 760 |
| 453 | UGAAACUUCGAAAGCAUCA | 690 | 453 | UGAAACUUCGAAAGCAUCA | 690 | 475 | UGAUGCUUUCGAAGUUUCA | 761 |
| 471 | AUUAUUUGCAGAGACAGGA | 691 | 471 | AUUAUUUGCAGAGACAGGA | 691 | 493 | UCCUGUCUCUGCAAAUAAU | 762 |
| 489 | ACCUGACUAUUGAAGUUGC | 692 | 489 | ACCUGACUAUUGAAGUUGC | 692 | 511 | GCAACUUCAAUAGUCAGGU | 763 |
| 507 | CAGAUUCAUUUUUCUUUCU | 693 | 507 | CAGAUUCAUUUUUCUUUCU | 693 | 529 | AGAAAGAAAAUGAAUCUG | 764 |
| 525 | UGAUGUCAAAAAUGUCUUG | 694 | 525 | UGAUGUCAAAAAUGUCUUG | 694 | 547 | CAAGACAUUUUUGACAUCA | 765 |
| 543 | GGGUAGGCGGGAAGGAGGG | 695 | 543 | GGGUAGGCGGGAAGGAGGG | 695 | 565 | CCCUCCUUCCCGCCUACCC | 766 |
| 561 | GUUAGGGAGGGGUAAAAUU | 696 | 561 | GUUAGGGAGGGGUAAAAUU | 696 | 583 | AAUUUUACCCCUCCCUAAC | 767 |
| 579 | UCCUUAGCUUAGACCUCAG | 697 | 579 | UCCUUAGCUUAGACCUCAG | 697 | 601 | CUGAGGUCUAAGCUAAGGA | 768 |
| 597 | GCCUGUGCUGCCCGUCUUC | 698 | 597 | GCCUGUGCUGCCCGUCUUC | 698 | 619 | GAAGACGGGCAGCACAGGC | 769 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 615 | CAGCCUAGCCGACCUCAGC | 699 | 615 | CAGCCUAGCCGACCUCAGC | 699 | 637 | GCUGAGGUCGGCUAGGCUG | 770 |
| 633 | CCUUCCCCUUGCCCAGGGC | 700 | 633 | CCUUCCCCUUGCCCAGGGC | 700 | 655 | GCCCUGGGCAAGGGGAAGG | 771 |
| 651 | CUCAGCCUGGUGGGCCUCC | 701 | 651 | CUCAGCCUGGUGGGCCUCC | 701 | 673 | GGAGGCCCACCAGGCUGAG | 772 |
| 669 | CUCUGUCCAGGGCCCUGAG | 702 | 669 | CUCUGUCCAGGGCCCUGAG | 702 | 691 | CUCAGGGCCCUGGACAGAG | 773 |
| 687 | GCUCGGUGGACCCAGGGAU | 703 | 687 | GCUCGGUGGACCCAGGGAU | 703 | 709 | AUCCCUGGGUCCACCGAGC | 774 |
| 705 | UGACAUGUCCCUACACCCC | 704 | 705 | UGACAUGUCCCUACACCCC | 704 | 727 | GGGGUGUAGGGACAUGUCA | 775 |
| 723 | CUCCCCUGCCCUAGAGCAC | 705 | 723 | CUCCCCUGCCCUAGAGCAC | 705 | 745 | GUGCUCUAGGGCAGGGGAG | 776 |
| 741 | CACUGUAGCAUUACAGUGG | 706 | 741 | CACUGUAGCAUUACAGUGG | 706 | 763 | CCACUGUAAUGCUACAGUG | 777 |
| 759 | GGUGCCCCCUUGCCAGAC | 707 | 759 | GGUGCCCCCUUGCCAGAC | 707 | 781 | GUCUGGCAAGGGGGCACC | 778 |
| 777 | CAUGUGGUGGACAGGGAC | 708 | 777 | CAUGUGGUGGACAGGGAC | 708 | 799 | GUCCCUGUCCCACCACAUG | 779 |
| 795 | CCCACUUCACACACAGGCA | 709 | 795 | CCCACUUCACACACAGGCA | 709 | 817 | UGCCUGUGUGUGAAGUGGG | 780 |
| 813 | AACUGAGGCAGACAGCAGC | 710 | 813 | AACUGAGGCAGACAGCAGC | 710 | 835 | GCUGCUGUCUGCCUCAGUU | 781 |
| 831 | CUCAGGCACACUUCUUCUU | 711 | 831 | CUCAGGCACACUUCUUCUU | 711 | 853 | AAGAAGAAGUGUGCCUGAG | 782 |
| 849 | UGGUCUUAUUUAUUAUUGU | 712 | 849 | UGGUCUUAUUUAUUAUUGU | 712 | 871 | ACAAUAAUAAAUAAGACCA | 783 |
| 867 | UGUGUUAUUUAAAUGAGUG | 713 | 867 | UGUGUUAUUUAAAUGAGUG | 713 | 889 | CACUCAUUUAAAUAACACA | 784 |
| 885 | GUGUUUGUCACCGUUGGGG | 714 | 885 | GUGUUUGUCACCGUUGGGG | 714 | 907 | CCCCAACGGUGACAAACAC | 785 |
| 903 | GAUUGGGGAAGACUGUGGC | 715 | 903 | GAUUGGGGAAGACUGUGGC | 715 | 925 | GCCACAGUCUUCCCCAAUC | 786 |
| 921 | CUGCUAGCACUUGGAGCCA | 716 | 921 | CUGCUAGCACUUGGAGCCA | 716 | 943 | UGGCUCCAAGUGCUAGCAG | 787 |
| 939 | AAGGGUUCAGAGACUCAGG | 717 | 939 | AAGGGUUCAGAGACUCAGG | 717 | 961 | CCUGAGUCUCUGAACCCUU | 788 |
| 957 | GGCCCCAGCACUAAAGCAG | 718 | 957 | GGCCCCAGCACUAAAGCAG | 718 | 979 | CUGCUUUAGUGCUGGGGCC | 789 |
| 975 | GUGGACACCAGGAGUCCCU | 719 | 975 | GUGGACACCAGGAGUCCCU | 719 | 997 | AGGGACUCCUGGUGUCCAC | 790 |
| 933 | UGGUAAUAAGUACUGUGUA | 720 | 993 | UGGUAAUAAGUACUGUGUA | 720 | 1015 | UACACAGUACUUAUUACCA | 791 |
| 1011 | ACAGAAUUCUGCUACCUCA | 721 | 1011 | ACAGAAUUCUGCUACCUCA | 721 | 1033 | UGAGGUAGCAGAAUUCUGU | 792 |
| 1029 | ACUGGGGUCCUGGGGCCUC | 722 | 1029 | ACUGGGGUCCUGGGGCCUC | 722 | 1051 | GAGGCCCCAGGACCCCAGU | 793 |
| 1047 | CGGAGCCUCAUCCGAGGCA | 723 | 1047 | CGGAGCCUCAUCCGAGGCA | 723 | 1069 | UGCCUCGGAUGAGGCUCCG | 794 |
| 1065 | AGGGUCAGGAGAGGGGCAG | 724 | 1065 | AGGGUCAGGAGAGGGGCAG | 724 | 1087 | CUGCCCCUCUCCUGACCCU | 795 |
| 1083 | GAACAGCCGCUCCUGUCUG | 725 | 1083 | GAACAGCCGCUCCUGUCUG | 725 | 1105 | CAGACAGGAGCGGCUGUUC | 796 |
| 1101 | GCCAGCCAGCAGCCAGCUC | 726 | 1101 | GCCAGCCAGCAGCCAGCUC | 726 | 1123 | GAGCUGGCUGCUGGCUGGC | 797 |
| 1119 | CUCAGCCAACGAGUAAUUU | 727 | 1119 | CUCAGCCAACGAGUAAUUU | 727 | 1141 | AAAUUACUCGUUGGCUGAG | 798 |
| 1137 | UAUUGUUUUUCCUUGUAUU | 728 | 1137 | UAUUGUUUUUCCUUGUAUU | 728 | 1159 | AAUACAAGGAAAAACAAUA | 799 |
| 1155 | UUAAAUAUUAAAUAUGUUA | 729 | 1155 | UUAAAUAUUAAAUAUGUUA | 729 | 1177 | UAACAUAUUUAAUAUUUAA | 800 |
| 1173 | AGCAAAGAGUUAAUAUAUA | 730 | 1173 | AGCAAAGAGUUAAUAUAUA | 730 | 1195 | UAUAUAUUAACUCUUUGCU | 801 |
| 1191 | AGAAGGGUACCUUGAACAC | 731 | 1191 | AGAAGGGUACCUUGAACAC | 731 | 1213 | GUGUUCAAGGUACCCUUCU | 802 |
| 1209 | CUGGGGGAGGGGACAUUGA | 732 | 1209 | CUGGGGGAGGGGACAUUGA | 732 | 1231 | UCAAUGUCCCCUCCCCCAG | 803 |
| 1227 | AACAAGUUGUUUCAUUGAC | 733 | 1227 | AACAAGUUGUUUCAUUGAC | 733 | 1249 | GUCAAUGAAACAACUUGUU | 804 |
| 1245 | CUAUCAAACUGAAGCCAGA | 734 | 1245 | CUAUCAAACUGAAGCCAGA | 734 | 1267 | UCUGGCUUCAGUUUGAUAG | 805 |
| 1262 | GAAAUAAAGUUGGUGACAG | 735 | 1262 | GAAAUAAAGUUGGUGACAG | 735 | 1284 | CUGUCACCAACUUUAUUUC | 806 |

TABLE II-continued

Interleukin and Interleukin receptor siNA and Target Sequences

IL13RA1 NM_001560

| Pos | Seq | Seq ID | UPos | Upper seq | Seq ID | LPos | Lower seq | Seq ID |
|---|---|---|---|---|---|---|---|---|
| 3 | CCAAGGCUCCAGCCCGGCC | 807 | 3 | CCAAGGCUCCAGCCCGGCC | 807 | 25 | GGCCGGGCUGGAGCCUUGG | 1030 |
| 21 | CGGGCUCCGAGGCGAGAGG | 808 | 21 | CGGGCUCCGAGGCGAGAGG | 808 | 43 | CCUCUCGCCUCGGAGCCCG | 1031 |
| 39 | GCUGCAUGGAGUGGCCGGC | 809 | 39 | GCUGCAUGGAGUGGCCGGC | 809 | 61 | GCCGGCCACUCCAUGCAGC | 1032 |
| 57 | CGCGGCUCUGCGGGCUGUG | 810 | 57 | CGCGGCUCUGCGGGCUGUG | 810 | 79 | CACAGCCCGCAGAGCCGCG | 1033 |
| 75 | GGGCGCUGCUGCUCUGCGC | 811 | 75 | GGGCGCUGCUGCUCUGCGC | 811 | 97 | GCGCAGAGCAGCAGCGCCC | 1034 |
| 93 | CCGGCGGCGGGGCGGGGG | 812 | 93 | CCGGCGGCGGGGCGGGGG | 812 | 115 | CCCCCGCCCCGCCGCCGG | 1035 |
| 111 | GCGGGGGCGCCGCGCCUAC | 813 | 111 | GCGGGGGCGCCGCGCCUAC | 813 | 133 | GUAGGCGCGGCGCCCCCGC | 1036 |
| 129 | CGGAAACUCAGCCACCUGU | 814 | 129 | CGGAAACUCAGCCACCUGU | 814 | 151 | ACAGGUGGCUGAGUUUCCG | 1037 |
| 147 | UGACAAAUUUGAGUGUCUC | 815 | 147 | UGACAAAUUUGAGUGUCUC | 815 | 169 | GAGACACUCAAAUUUGUCA | 1038 |
| 165 | CUGUUGAAAACCUCUGCAC | 816 | 165 | CUGUUGAAAACCUCUGCAC | 816 | 187 | GUGCAGAGGUUUUCAACAG | 1039 |
| 183 | CAGUAAUAUGGACAUGGAA | 817 | 183 | CAGUAAUAUGGACAUGGAA | 817 | 205 | UUCCAUGUCCAUAUUACUG | 1040 |
| 201 | AUCCACCCGAGGGAGCCAG | 818 | 201 | AUCCACCCGAGGGAGCCAG | 818 | 223 | CUGGCUCCCUCGGGUGGAU | 1041 |
| 219 | GCUCAAAUUGUAGUCUAUG | 819 | 219 | GCUCAAAUUGUAGUCUAUG | 819 | 241 | CAUAGACUACAAUUUGAGC | 1042 |
| 237 | GGUAUUUUAGUCAUUUUGG | 820 | 237 | GGUAUUUUAGUCAUUUUGG | 820 | 259 | CCAAAAUGACUAAAAUACC | 1043 |
| 255 | GCGACAAACAAGAUAAGAA | 821 | 255 | GCGACAAACAAGAUAAGAA | 821 | 277 | UUCUUAUCUUGUUUGUCGC | 1044 |
| 273 | AAAUAGCUCCGGAAACUCG | 822 | 273 | AAAUAGCUCCGGAAACUCG | 822 | 295 | CGAGUUUCCGGAGCUAUUU | 1045 |
| 291 | GUCGUUCAAUAGAAGUACC | 823 | 291 | GUCGUUCAAUAGAAGUACC | 823 | 313 | GGUACUUCUAUUGAACGAC | 1046 |
| 309 | CCCUGAAUGAGAGGAUUUG | 824 | 309 | CCCUGAAUGAGAGGAUUUG | 824 | 331 | CAAAUCCUCUCAUUCAGGG | 1047 |
| 327 | GUCUGCAAGUGGGGUCCCA | 825 | 327 | GUCUGCAAGUGGGGUCCCA | 825 | 349 | UGGGACCCCACUUGCAGAC | 1048 |
| 345 | AGUGUAGCACCAAUGAGAG | 826 | 345 | AGUGUAGCACCAAUGAGAG | 826 | 367 | CUCUCAUUGGUGCUACACU | 1049 |
| 363 | GUGAGAAGCCUAGCAUUUU | 827 | 363 | GUGAGAAGCCUAGCAUUUU | 827 | 385 | AAAAUGCUAGGCUUCUCAC | 1050 |
| 381 | UGGUUGAAAAAUGCAUCUC | 828 | 381 | UGGUUGAAAAAUGCAUCUC | 828 | 403 | GAGAUGCAUUUUUCAACCA | 1051 |
| 399 | CACCCCAGAAGGUGAUCC | 829 | 399 | CACCCCAGAAGGUGAUCC | 829 | 421 | GGAUCACCUUCUGGGGGUG | 1052 |
| 417 | CUGAGUCUGCUGUGACUGA | 830 | 417 | CUGAGUCUGCUGUGACUGA | 830 | 439 | UCAGUCACAGCAGACUCAG | 1053 |
| 435 | AGCUUCAAUGCAUUUGGCA | 831 | 435 | AGCUUCAAUGCAUUUGGCA | 831 | 457 | UGCCAAAUGCAUUGAAGCU | 1054 |
| 453 | ACAACCUGAGCUACAUGAA | 832 | 453 | ACAACCUGAGCUACAUGAA | 832 | 475 | UUCAUGUAGCUCAGGUUGU | 1055 |
| 471 | AGUGUUCUUGGCUCCCUGG | 833 | 471 | AGUGUUCUUGGCUCCCUGG | 833 | 493 | CCAGGGAGCCAAGAACACU | 1056 |
| 489 | GAAGGAAUACCAGUCCCGA | 834 | 489 | GAAGGAAUACCAGUCCCGA | 834 | 511 | UCGGGACUGGUAUUCCUUC | 1057 |
| 507 | ACACUAACUAUACUCUCUA | 835 | 507 | ACACUAACUAUACUCUCUA | 835 | 529 | UAGAGAGUAUAGUUAGUGU | 1058 |
| 525 | ACUAUUGGCACAGAAGCCU | 836 | 525 | ACUAUUGGCACAGAAGCCU | 836 | 547 | AGGCUUCUGUGCCAAUAGU | 1059 |
| 543 | UGGAAAAAUUCAUCAAUG | 837 | 543 | UGGAAAAAUUCAUCAAUG | 837 | 565 | CAUUGAUGAAUUUUUCCA | 1060 |
| 561 | GUGAAAACAUCUUUAGAGA | 838 | 561 | GUGAAAACAUCUUUAGAGA | 838 | 583 | UCUCUAAAGAUGUUUUCAC | 1061 |
| 579 | AAGGCCAAUACUUUGGUUG | 839 | 579 | AAGGCCAAUACUUUGGUUG | 839 | 601 | CAACCAAAGUAUUGGCCUU | 1062 |
| 597 | GUUCCUUUGAUCUGACCAA | 840 | 597 | GUUCCUUUGAUCUGACCAA | 840 | 619 | UUGGUCAGAUCAAAGGAAC | 1063 |
| 615 | AAGUGAAGGAUUCCAGUUU | 841 | 615 | AAGUGAAGGAUUCCAGUUU | 841 | 637 | AAACUGGAAUCCUUCACUU | 1064 |
| 633 | UUGAACAACACAGUGUCCA | 842 | 633 | UUGAACAACACAGUGUCCA | 842 | 655 | UGGACACUGUGUUGUUCAA | 1065 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 651 | AAAUAAUGGUCAAGGAUAA | 843 | 651 | AAAUAAUGGUCAAGGAUAA | 843 | 673 | UUAUCCUUGACCAUUAUUU | 1066 |
| 669 | AUGCAGGAAAAAUUAAACC | 844 | 669 | AUGCAGGAAAAAUUAAACC | 844 | 691 | GGUUUAAUUUUUCCUGCAU | 1067 |
| 687 | CAUCCUUCAAUAUAGUGCC | 845 | 687 | CAUCCUUCAAUAUAGUGCC | 845 | 709 | GGCACUAUAUUGAAGGAUG | 1068 |
| 705 | CUUUAACUUCCCGUGUGAA | 846 | 705 | CUUUAACUUCCCGUGUGAA | 846 | 727 | UUCACACGGGAAGUUAAAG | 1069 |
| 723 | AACCUGAUCCUCCACAUAU | 847 | 723 | AACCUGAUCCUCCACAUAU | 847 | 745 | AUAUGUGGAGGAUCAGGUU | 1070 |
| 741 | UUAAAAACCUCUCCUUCCA | 848 | 741 | UUAAAAACCUCUCCUUCCA | 848 | 763 | UGGAAGGAGAGGUUUUUAA | 1071 |
| 759 | ACAAUGAUGACCUAUAUGU | 849 | 759 | ACAAUGAUGACCUAUAUGU | 849 | 781 | ACAUAUAGGUCAUCAUUGU | 1072 |
| 777 | UGCAAUGGGAGAAUCCACA | 850 | 777 | UGCAAUGGGAGAAUCCACA | 850 | 799 | UGUGGAUUCUCCCAUUGCA | 1073 |
| 795 | AGAAUUUUAUUAGCAGAUG | 851 | 795 | AGAAUUUUAUUAGCAGAUG | 851 | 817 | CAUCUGCUAAUAAAAUUCU | 1074 |
| 813 | GCCUAUUUUAUGAAGUAGA | 852 | 813 | GCCUAUUUUAUGAAGUAGA | 852 | 835 | UCUACUUCAUAAAAUAGGC | 1075 |
| 831 | AAGUCAAUAACAGCCAAAC | 853 | 831 | AAGUCAAUAACAGCCAAAC | 853 | 853 | GUUUGGCUGUUAUUGACUU | 1076 |
| 849 | CUGAGACACAUAAUGUUUU | 854 | 849 | CUGAGACACAUAAUGUUUU | 854 | 871 | AAAACAUUAUGUGUCUCAG | 1077 |
| 867 | UCUACGUCCAAGAGGCUAA | 855 | 867 | UCUACGUCCAAGAGGCUAA | 855 | 889 | UUAGCCUCUUGGACGUAGA | 1078 |
| 885 | AAUGUGAGAAUCCAGAAUU | 856 | 885 | AAUGUGAGAAUCCAGAAUU | 856 | 907 | AAUUCUGGAUUCUCACAUU | 1079 |
| 903 | UUGAGAGAAAUGUGGAGAA | 857 | 903 | UUGAGAGAAAUGUGGAGAA | 857 | 925 | UUCUCCACAUUUCUCUCAA | 1080 |
| 921 | AUACAUCUUGUUUCAUGGU | 858 | 921 | AUACAUCUUGUUUCAUGGU | 858 | 943 | ACCAUGAAACAAGAUGUAU | 1081 |
| 939 | UCCCUGGUGUUCUUCCUGA | 859 | 939 | UCCCUGGUGUUCUUCCUGA | 859 | 961 | UCAGGAAGAACACCAGGGA | 1082 |
| 957 | AUACUUUGAACACAGUCAG | 860 | 957 | AUACUUUGAACACAGUCAG | 860 | 979 | CUGACUGUGUUCAAAGUAU | 1083 |
| 975 | GAAUAAGAGUCAAAACAAA | 861 | 975 | GAAUAAGAGUCAAAACAAA | 861 | 997 | UUUGUUUUGACUCUUAUUC | 1084 |
| 993 | AUAAGUUAUGCUAUGAGGA | 862 | 993 | AUAAGUUAUGCUAUGAGGA | 862 | 1015 | UCCUCAUAGCAUAACUUAU | 1085 |
| 1011 | AUGACAAACUCUGGAGUAA | 863 | 1011 | AUGACAAACUCUGGAGUAA | 863 | 1033 | UUACUCCAGAGUUUGUCAU | 1086 |
| 1029 | AUUGGAGCCAAGAAAUGAG | 864 | 1029 | AUUGGAGCCAAGAAAUGAG | 864 | 1051 | CUCAUUUCUUGGCUCCAAU | 1087 |
| 1047 | GUAUAGGUAAGAAGCGCAA | 865 | 1047 | GUAUAGGUAAGAAGCGCAA | 865 | 1069 | UUGCGCUUCUUACCUAUAC | 1088 |
| 1065 | AUUCCACACUCUACAUAAC | 866 | 1065 | AUUCCACACUCUACAUAAC | 866 | 1087 | GUUAUGUAGAGUGUGGAAU | 1089 |
| 1083 | CCAUGUUACUCAUUGUUCC | 867 | 1083 | CCAUGUUACUCAUUGUUCC | 867 | 1105 | GGAACAAUGAGUAACAUGG | 1090 |
| 1101 | CAGUCAUCGUCGCAGGUGC | 868 | 1101 | CAGUCAUCGUCGCAGGUGC | 868 | 1123 | GCACCUGCGACGAUGACUG | 1091 |
| 1119 | CAAUCAUAGUACUCCUGCU | 869 | 1119 | CAAUCAUAGUACUCCUGCU | 869 | 1141 | AGCAGGAGUACUAUGAUUG | 1092 |
| 1137 | UUUACCUAAAAAGGCUCAA | 870 | 1137 | UUUACCUAAAAAGGCUCAA | 870 | 1159 | UUGAGCCUUUUUAGGUAAA | 1093 |
| 1155 | AGAUUAUUAUAUUCCCUCC | 871 | 1155 | AGAUUAUUAUAUUCCCUCC | 871 | 1177 | GGAGGGAAUAUAAUAAUCU | 1094 |
| 1173 | CAAUUCCUGAUCCUGGCAA | 872 | 1173 | CAAUUCCUGAUCCUGGCAA | 872 | 1195 | UUGCCAGGAUCAGGAAUUG | 1095 |
| 1191 | AGAUUUUUAAAGAAAUGUU | 873 | 1191 | AGAUUUUUAAAGAAAUGUU | 873 | 1213 | AACAUUUCUUUAAAAAUCU | 1096 |
| 1209 | UUGGAGACCAGAAUGAUGA | 874 | 1209 | UUGGAGACCAGAAUGAUGA | 874 | 1231 | UCAUCAUUCUGGUCUCCAA | 1097 |
| 1227 | AUACUCUGCACUGGAAGAA | 875 | 1227 | AUACUCUGCACUGGAAGAA | 875 | 1249 | UUCUUCCAGUGCAGAGUAU | 1098 |
| 1245 | AGUACGACAUCUAUGAGAA | 876 | 1245 | AGUACGACAUCUAUGAGAA | 876 | 1267 | UUCUCAUAGAUGUCGUACU | 1099 |
| 1263 | AGCAAACCAAGGAGGAAAC | 877 | 1263 | AGCAAACCAAGGAGGAAAC | 877 | 1285 | GUUUCCUCCUUGGUUUGCU | 1100 |
| 1281 | CCGACUCUGUAGUGCUAU | 878 | 1281 | CCGACUCUGUAGUGCUAU | 878 | 1303 | AUCAGCACUACAGAGUCGG | 1101 |
| 1299 | UAGAAAACCUGAAGAAAGC | 879 | 1299 | UAGAAAACCUGAAGAAAGC | 879 | 1321 | GCUUUCUUCAGGUUUUCUA | 1102 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 1317 | CCUCUCAGUGAUGGAGAUA | 880 | 1317 | CCUCUCAGUGAUGGAGAUA | 880 | 1339 | UAUCUCCAUCACUGAGAGG | 1103 |
| 1335 | AAUUUAUUUUUACCUUCAC | 881 | 1335 | AAUUUAUUUUUACCUUCAC | 881 | 1357 | GUGAAGGUAAAAAUAAAUU | 1104 |
| 1353 | CUGUGACCUUGAGAAGAUU | 882 | 1353 | CUGUGACCUUGAGAAGAUU | 882 | 1375 | AAUCUUCUCAAGGUCACAG | 1105 |
| 1371 | UCUUCCCAUUCUCCAUUUG | 883 | 1371 | UCUUCCCAUUCUCCAUUUG | 883 | 1393 | CAAAUGGAGAAUGGGAAGA | 1106 |
| 1389 | GUUAUCUGGGAACUUAUUA | 884 | 1389 | GUUAUCUGGGAACUUAUUA | 884 | 1411 | UAAUAAGUUCCCAGAUAAC | 1107 |
| 1407 | AAAUGGAAACUGAAACUAC | 885 | 1407 | AAAUGGAAACUGAAACUAC | 885 | 1429 | GUAGUUUCAGUUUCCAUUU | 1108 |
| 1425 | CUGCACCAUUUAAAAACAG | 886 | 1425 | CUGCACCAUUUAAAAACAG | 886 | 1447 | CUGUUUUUAAAUGGUGCAG | 1109 |
| 1443 | GGCAGCUCAUAAGAGCCAC | 887 | 1443 | GGCAGCUCAUAAGAGCCAC | 887 | 1465 | GUGGCUCUUAUGAGCUGCC | 1110 |
| 1461 | CAGGUCUUUAUGUUGAGUC | 888 | 1461 | CAGGUCUUUAUGUUGAGUC | 888 | 1483 | GACUCAACAUAAAGACCUG | 1111 |
| 1479 | CGCGCACCGAAAAACUAAA | 889 | 1479 | CGCGCACCGAAAAACUAAA | 889 | 1501 | UUUAGUUUUCGGUGCGCG | 1112 |
| 1497 | AAAUAAUGGGCGCUUUGGA | 890 | 1497 | AAAUAAUGGGCGCUUUGGA | 890 | 1519 | UCCAAAGCGCCCAUUAUUU | 1113 |
| 1515 | AGAAGAGUGUGGAGUCAUU | 891 | 1515 | AGAAGAGUGUGGAGUCAUU | 891 | 1537 | AAUGACUCCACACUCUUCU | 1114 |
| 1533 | UCUCAUUGAAUUAUAAAG | 892 | 1533 | UCUCAUUGAAUUAUAAAAG | 892 | 1555 | CUUUUAUAAUUCAAUGAGA | 1115 |
| 1551 | GCCAGCAGGCUUCAAACUA | 893 | 1551 | GCCAGCAGGCUUCAAACUA | 893 | 1573 | UAGUUUGAAGCCUGCUGGC | 1116 |
| 1569 | AGGGGACAAAGCAAAAAGU | 894 | 1569 | AGGGGACAAAGCAAAAAGU | 894 | 1591 | ACUUUUUGCUUUGUCCCCU | 1117 |
| 1587 | UGAUGAUAGUGGUGGAGUU | 895 | 1587 | UGAUGAUAGUGGUGGAGUU | 895 | 1609 | AACUCCACCACUAUCAUCA | 1118 |
| 1605 | UAAUCUUAUCAAGAGUUGU | 896 | 1605 | UAAUCUUAUCAAGAGUUGU | 896 | 1627 | ACAACUCUUGAUAAGAUUA | 1119 |
| 1623 | UGACAACUUCCUGAGGGAU | 897 | 1623 | UGACAACUUCCUGAGGGAU | 897 | 1645 | AUCCCUCAGGAAGUUGUCA | 1120 |
| 1641 | UCUAUACUUGCUUUGUGUU | 898 | 1641 | UCUAUACUUGCUUUGUGUU | 898 | 1663 | AACACAAAGCAAGUAUAGA | 1121 |
| 1659 | UCUUUGUGUCAACAUGAAC | 899 | 1659 | UCUUUGUGUCAACAUGAAC | 899 | 1681 | GUUCAUGUUGACACAAAGA | 1122 |
| 1677 | CAAAUUUUAUUUGUAGGGG | 900 | 1677 | CAAAUUUUAUUUGUAGGGG | 900 | 1699 | CCCCUACAAAUAAAAUUUG | 1123 |
| 1695 | GAACUCAUUUGGGGUGCAA | 901 | 1695 | GAACUCAUUUGGGGUGCAA | 901 | 1717 | UUGCACCCCAAAUGAGUUC | 1124 |
| 1713 | AAUGCUAAUGUCAAACUUG | 902 | 1713 | AAUGCUAAUGUCAAACUUG | 902 | 1735 | CAAGUUUGACAUUAGCAUU | 1125 |
| 1731 | GAGUCACAAAGAACAUGUA | 903 | 1731 | GAGUCACAAAGAACAUGUA | 903 | 1753 | UACAUGUUCUUUGUGACUC | 1126 |
| 1749 | AGAAAACAAAAUGGAUAAA | 904 | 1749 | AGAAAACAAAAUGGAUAAA | 904 | 1771 | UUUAUCCAUUUUGUUUUCU | 1127 |
| 1767 | AAUCUGAUAUGUAUUGUUU | 905 | 1767 | AAUCUGAUAUGUAUUGUUU | 905 | 1789 | AAACAAUACAUAUCAGAUU | 1128 |
| 1785 | UGGGAUCCUAUUGAACCAU | 906 | 1785 | UGGGAUCCUAUUGAACCAU | 906 | 1807 | AUGGUUCAAUAGGAUCCCA | 1129 |
| 1803 | UGUUUGUGGCUAUUAAAAC | 907 | 1803 | UGUUUGUGGCUAUUAAAAC | 907 | 1825 | GUUUUAAUAGCCACAAACA | 1130 |
| 1821 | CUCUUUUAACAGUCUGGGC | 908 | 1821 | CUCUUUUAACAGUCUGGGC | 908 | 1843 | GCCCAGACUGUUAAAAGAG | 1131 |
| 1839 | CUGGGUCCGGUGGCUCACG | 909 | 1839 | CUGGGUCCGGUGGCUCACG | 909 | 1861 | CGUGAGCCACCGGACCCAG | 1132 |
| 1857 | GCCUGUAAUCCCAGCAAUU | 910 | 1857 | GCCUGUAAUCCCAGCAAUU | 910 | 1879 | AAUUGCUGGGAUUACAGGC | 1133 |
| 1875 | UUGGGAGUCCGAGGCGGGC | 911 | 1875 | UUGGGAGUCCGAGGCGGGC | 911 | 1897 | GCCCGCCUCGGACUCCCAA | 1134 |
| 1893 | CGGAUCACUCGAGGUCAGG | 912 | 1893 | CGGAUCACUCGAGGUCAGG | 912 | 1915 | CCUGACCUCGAGUGAUCCG | 1135 |
| 1911 | GAGUUCCAGACCAGCCUGA | 913 | 1911 | GAGUUCCAGACCAGCCUGA | 913 | 1933 | UCAGGCUGGUCUGGAACUC | 1136 |
| 1929 | ACCAAAAUGGUGAAACCUC | 914 | 1929 | ACCAAAAUGGUGAAACCUC | 914 | 1951 | GAGGUUUCACCAUUUUGGU | 1137 |
| 1947 | CCUCUCUACUAAAACUACA | 915 | 1947 | CCUCUCUACUAAAACUACA | 915 | 1969 | UGUAGUUUUAGUAGAGAGG | 1138 |
| 1965 | AAAAAUUAACUGGGUGUGG | 916 | 1965 | AAAAAUUAACUGGGUGUGG | 916 | 1987 | CCACACCCAGUUAAUUUUU | 1139 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 1983 | GUGGCGCGUGCCUGUAAUC | 917 | 1983 | GUGGCGCGUGCCUGUAAUC | 917 | 2005 | GAUUACAGGCACGCGCCAC | 1140 |
| 2001 | CCCAGCUACUCGGGAAGCU | 918 | 2001 | CCCAGCUACUCGGGAAGCU | 918 | 2023 | AGCUUCCCGAGUAGCUGGG | 1141 |
| 2019 | UGAGGCAGGUGAAUUGUUU | 919 | 2019 | UGAGGCAGGUGAAUUGUUU | 919 | 2041 | AAACAAUUCACCUGCCUCA | 1142 |
| 2037 | UGAACCUGGGAGGUGGAGG | 920 | 2037 | UGAACCUGGGAGGUGGAGG | 920 | 2059 | CCUCCACCUCCCAGGUUCA | 1143 |
| 2055 | GUUGCAGUGAGCAGAGAUC | 921 | 2055 | GUUGCAGUGAGCAGAGAUC | 921 | 2077 | GAUCUCUGCUCACUGCAAC | 1144 |
| 2073 | CACACCACUGCACUCUAGC | 922 | 2073 | CACACCACUGCACUCUAGC | 922 | 2095 | GCUAGAGUGCAGUGGUGUG | 1145 |
| 2091 | CCUGGGUGACAGAGCAAGA | 923 | 2091 | CCUGGGUGACAGAGCAAGA | 923 | 2113 | UCUUGCUCUGUCACCCAGG | 1146 |
| 2109 | ACUCUGUCUAAAAAACAAA | 924 | 2109 | ACUCUGUCUAAAAAACAAA | 924 | 2131 | UUUGUUUUUAGACAGAGU | 1147 |
| 2127 | AACAAAACAAAACAAAACA | 925 | 2127 | AACAAAACAAAACAAAACA | 925 | 2149 | UGUUUUGUUUUGUUUUGUU | 1148 |
| 2145 | AAAAAAACCUCUUAAUAUU | 926 | 2145 | AAAAAAACCUCUUAAUAUU | 926 | 2167 | AAUAUUAAGAGGUUUUUUU | 1149 |
| 2163 | UCUGGAGUCAUCAUUCCCU | 927 | 2163 | UCUGGAGUCAUCAUUCCCU | 927 | 2185 | AGGGAAUGAUGACUCCAGA | 1150 |
| 2181 | UUCGACAGCAUUUUCCUCU | 928 | 2181 | UUCGACAGCAUUUUCCUCU | 928 | 2203 | AGAGGAAAAUGCUGUCGAA | 1151 |
| 2199 | UGCUUUGAAAGCCCCAGAA | 929 | 2199 | UGCUUUGAAAGCCCCAGAA | 929 | 2221 | UUCGGGGCUUUCAAAGCA | 1152 |
| 2217 | AAUCAGUGUUGGCCAUGAU | 930 | 2217 | AAUCAGUGUUGGCCAUGAU | 930 | 2239 | AUCAUGGCCAACACUGAUU | 1153 |
| 2235 | UGACAACUACAGAAAAACC | 931 | 2235 | UGACAACUACAGAAAAACC | 931 | 2257 | GGUUUUUCUGUAGUUGUCA | 1154 |
| 2253 | CAGAGGCAGCUUCUUUGCC | 932 | 2253 | CAGAGGCAGCUUCUUUGCC | 932 | 2275 | GGCAAAGAAGCUGCCUCUG | 1155 |
| 2271 | CAAGACCUUUCAAAGCCAU | 933 | 2271 | CAAGACCUUUCAAAGCCAU | 933 | 2293 | AUGGCUUUGAAAGGUCUUG | 1156 |
| 2289 | UUUUAGGCUGUUAGGGGCA | 934 | 2289 | UUUUAGGCUGUUAGGGGCA | 934 | 2311 | UGCCCCUAACAGCCUAAAA | 1157 |
| 2307 | AGUGGAGGUAGAAUGACUC | 935 | 2307 | AGUGGAGGUAGAAUGACUC | 935 | 2329 | GAGUCAUUCUACCUCCACU | 1158 |
| 2325 | CCUUGGGUAUUAGAGUUUC | 936 | 2325 | CCUUGGGUAUUAGAGUUUC | 936 | 2347 | GAAACUCUAAUACCCAAGG | 1159 |
| 2343 | CAACCAUGAAGUCUCUAAC | 937 | 2343 | CAACCAUGAAGUCUCUAAC | 937 | 2365 | GUUAGAGACUUCAUGGUUG | 1160 |
| 2361 | CAAUGUAUUUCUUCACCU | 938 | 2361 | CAAUGUAUUUCUUCACCU | 938 | 2383 | AGGUGAAGAAAAUACAUUG | 1161 |
| 2379 | UCUGCUACUCAAGUAGCAU | 939 | 2379 | UCUGCUACUCAAGUAGCAU | 939 | 2401 | AUGCUACUUGAGUAGCAGA | 1162 |
| 2397 | UUUACUGUGUCUUUGGUUU | 940 | 2397 | UUUACUGUGUCUUUGGUUU | 940 | 2419 | AAACCAAAGACACAGUAAA | 1163 |
| 2415 | UGUGCUAGGCCCCCGGGUG | 941 | 2415 | UGUGCUAGGCCCCCGGGUG | 941 | 2437 | CACCCGGGGGCCUAGCACA | 1164 |
| 2433 | GUGAAGCACAGACCCCUUC | 942 | 2433 | GUGAAGCACAGACCCCUUC | 942 | 2455 | GAAGGGGUCUGUGCUUCAC | 1165 |
| 2451 | CCAGGGGUUUACAGUCUAU | 943 | 2451 | CCAGGGGUUUACAGUCUAU | 943 | 2473 | AUAGACUGUAAACCCCUGG | 1166 |
| 2469 | UUUGAGACUCCUCAGUUCU | 944 | 2469 | UUUGAGACUCCUCAGUUCU | 944 | 2491 | AGAACUGGAGGUCUCAAA | 1167 |
| 2487 | UUGCCACUUUUUUUUUUAA | 945 | 2487 | UUGCCACUUUUUUUUUUAA | 945 | 2509 | UUAAAAAAAAAAGUGGCAA | 1168 |
| 2505 | AUCUCCACCAGUCAUUUUU | 946 | 2505 | AUCUCCACCAGUCAUUUUU | 946 | 2527 | AAAAAUGACUGGUGGAGAU | 1169 |
| 2523 | UCAGACCUUUUAACUCCUC | 947 | 2523 | UCAGACCUUUUAACUCCUC | 947 | 2545 | GAGGAGUUAAAAGGUCUGA | 1170 |
| 2541 | CAAUCCAACACUGAUUUC | 948 | 2541 | CAAUCCAACACUGAUUUC | 948 | 2563 | GAAAUCAGUGUUGGAAUUG | 1171 |
| 2559 | CCCCUUUUGCAUUCUCCCU | 949 | 2559 | CCCCUUUUGCAUUCUCCCU | 949 | 2581 | AGGGAGAAUGCAAAGGGG | 1172 |
| 2577 | UCCUUCCCUUCCUUGUAGC | 950 | 2577 | UCCUUCCCUUCCUUGUAGC | 950 | 2599 | GCUACAAGGAAGGGAAGGA | 1173 |
| 2595 | CCUUUUGACUUUCAUUGGA | 951 | 2595 | CCUUUUGACUUUCAUUGGA | 951 | 2617 | UCCAAUGAAAGUCAAAGG | 1174 |
| 2613 | AAAUUAGGAUGUAAAUCUG | 952 | 2613 | AAAUUAGGAUGUAAAUCUG | 952 | 2635 | CAGAUUUACAUCCUAAUUU | 1175 |
| 2631 | GCUCAGGAGACCUGGAGGA | 953 | 2631 | GCUCAGGAGACCUGGAGGA | 953 | 2653 | UCCUCCAGGUCUCCUGAGC | 1176 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 2649 | AGCAGAGGAUAAUUAGCAU | 954 | 2649 | AGCAGAGGAUAAUUAGCAU | 954 | 2671 | AUGCUAAUUAUCCUCUGCU | 1177 |
| 2667 | UCUCAGGUUAAGUGUGAGU | 955 | 2667 | UCUCAGGUUAAGUGUGAGU | 955 | 2689 | ACUCACACUUAACCUGAGA | 1178 |
| 2685 | UAAUCUGAGAAACAAUGAC | 956 | 2685 | UAAUCUGAGAAACAAUGAC | 956 | 2707 | GUCAUUGUUUCUCAGAUUA | 1179 |
| 2703 | CUAAUUCUUGCAUAUUUUG | 957 | 2703 | CUAAUUCUUGCAUAUUUUG | 957 | 2725 | CAAAAUAUGCAAGAAUUAG | 1180 |
| 2721 | GUAACUUCCAUGUGAGGGU | 958 | 2721 | GUAACUUCCAUGUGAGGGU | 958 | 2743 | ACCCUCACAUGGAAGUUAC | 1181 |
| 2739 | UUUUCAGCAUUGAUAUUUG | 959 | 2739 | UUUUCAGCAUUGAUAUUUG | 959 | 2761 | CAAAUAUCAAUGCUGAAAA | 1182 |
| 2757 | GUGCAUUUUCUAAACAGAG | 960 | 2757 | GUGCAUUUUCUAAACAGAG | 960 | 2779 | CUCUGUUUAGAAAAUGCAC | 1183 |
| 2775 | GAUGAGGUGGUAUCUUCAC | 961 | 2775 | GAUGAGGUGGUAUCUUCAC | 961 | 2797 | GUGAAGAUACCACCUCAUC | 1184 |
| 2793 | CGUAGAACAUUGGUAUUCG | 962 | 2793 | CGUAGAACAUUGGUAUUCG | 962 | 2815 | CGAAUACCAAUGUUCUACG | 1185 |
| 2811 | GCUUGAGAAAAAAGAAUA | 963 | 2811 | GCUUGAGAAAAAAGAAUA | 963 | 2833 | UAUUCUUUUUUUCUCAAGC | 1186 |
| 2829 | AGUUGAACCUAUUUCUCUU | 964 | 2829 | AGUUGAACCUAUUUCUCUU | 964 | 2851 | AAGAGAAAUAGGUUCAACU | 1187 |
| 2847 | UUCUUUACAAGAUGGGUCC | 965 | 2847 | UUCUUUACAAGAUGGGUCC | 965 | 2869 | GGACCCAUCUUGUAAAGAA | 1188 |
| 2865 | CAGGAUUCCUCUUUUCUCU | 966 | 2865 | CAGGAUUCCUCUUUUCUCU | 966 | 2887 | AGAGAAAAGAGGAAUCCUG | 1189 |
| 2883 | UGCCAUAAAUGAUUAAUUA | 967 | 2883 | UGCCAUAAAUGAUUAAUUA | 967 | 2905 | UAAUUAAUCAUUUAUGGCA | 1190 |
| 2901 | AAAUAGCUUUUGUGUCUUA | 968 | 2901 | AAAUAGCUUUUGUGUCUUA | 968 | 2923 | UAAGACACAAAAGCUAUUU | 1191 |
| 2919 | ACAUUGGUAGCCAGCCAGC | 969 | 2919 | ACAUUGGUAGCCAGCCAGC | 969 | 2941 | GCUGGCUGGCUACCAAUGU | 1192 |
| 2937 | CCAAGGCUCUGUUUAUGCU | 970 | 2937 | CCAAGGCUCUGUUUAUGCU | 970 | 2959 | AGCAUAAACAGAGCCUUGG | 1193 |
| 2955 | UUUUGGGGGCAUAUAUUG | 971 | 2955 | UUUUGGGGGCAUAUAUUG | 971 | 2977 | CAAUAUAUGCCCCCCAAAA | 1194 |
| 2973 | GGGUUCCAUUCUCACCUAU | 972 | 2973 | GGGUUCCAUUCUCACCUAU | 972 | 2995 | AUAGGUGAGAAUGGAACCC | 1195 |
| 2991 | UCCACACAACAUAUCCGUA | 973 | 2991 | UCCACACAACAUAUCCGUA | 973 | 3013 | UACGGAUAUGUUGUGUGGA | 1196 |
| 3009 | AUAUAUCCCCUCUACUCUU | 974 | 3009 | AUAUAUCCCCUCUACUCUU | 974 | 3031 | AAGAGUAGAGGGGAUAUAU | 1197 |
| 3027 | UACUUCCCCCAAAUUUAAA | 975 | 3027 | UACUUCCCCCAAAUUUAAA | 975 | 3049 | UUUAAAUUUGGGGGAAGUA | 1198 |
| 3045 | AGAAGUAUGGGAAAUGAGA | 976 | 3045 | AGAAGUAUGGGAAAUGAGA | 976 | 3067 | UCUCAUUUCCCAUACUUCU | 1199 |
| 3063 | AGGCAUUUCCCCCACCCCA | 977 | 3063 | AGGCAUUUCCCCCACCCCA | 977 | 3085 | UGGGGUGGGGGAAAUGCCU | 1200 |
| 3081 | AUUUCUCUCCUCACACACA | 978 | 3081 | AUUUCUCUCCUCACACACA | 978 | 3103 | UGUGUGUGAGGAGAGAAAU | 1201 |
| 3099 | AGACUCAUAUUACUGGUAG | 979 | 3099 | AGACUCAUAUUACUGGUAG | 979 | 3121 | CUACCAGUAAUAUGAGUCU | 1202 |
| 3117 | GGAACUUGAGAACUUUAUU | 980 | 3117 | GGAACUUGAGAACUUUAUU | 980 | 3139 | AAUAAAGUUCUCAAGUUCC | 1203 |
| 3135 | UUCCAAGUUGUUCAAACAU | 981 | 3135 | UUCCAAGUUGUUCAAACAU | 981 | 3157 | AUGUUUGAACAACUUGGAA | 1204 |
| 3153 | UUUACCAAUCAUAUUAAUA | 982 | 3153 | UUUACCAAUCAUAUUAAUA | 982 | 3175 | UAUUAAUAUGAUUGGUAAA | 1205 |
| 3171 | ACAUGAUGCUAUUUGCAA | 983 | 3171 | ACAUGAUGCUAUUUGCAA | 983 | 3193 | UUGCAAAUAGCAUCAUUGU | 1206 |
| 3189 | AUUCCUGCUCCUAGGGGAG | 984 | 3189 | AUUCCUGCUCCUAGGGGAG | 984 | 3211 | CUCCCCUAGGAGCAGGAAU | 1207 |
| 3207 | GGGGAGAUAAGAAACCCUC | 985 | 3207 | GGGGAGAUAAGAAACCCUC | 985 | 3229 | GAGGGUUUCUUAUCUCCCC | 1208 |
| 3225 | CACUCUCUACAGGUUUGGG | 986 | 3225 | CACUCUCUACAGGUUUGGG | 986 | 3247 | CCCAAACCUGUAGAGAGUG | 1209 |
| 3243 | GUACAAGUGGCAACCUGCU | 987 | 3243 | GUACAAGUGGCAACCUGCU | 987 | 3265 | AGCAGGUUGCCACUUGUAC | 1210 |
| 3261 | UUCCAUGGCCGUGUAGAAG | 988 | 3261 | UUCCAUGGCCGUGUAGAAG | 988 | 3283 | CUUCUACACGGCCAUGGAA | 1211 |
| 3279 | GCAUGGUGCCCUGGCUUCU | 989 | 3279 | GCAUGGUGCCCUGGCUUCU | 989 | 3301 | AGAAGCCAGGGCACCAUGC | 1212 |
| 3297 | UCUGAGGAAGCUGGGGUUC | 990 | 3297 | UCUGAGGAAGCUGGGGUUC | 990 | 3319 | GAACCCCAGCUUCCUCAGA | 1213 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 3315 | CAUGACAAUGGCAGAUGUA | 991 | 3315 | CAUGACAAUGGCAGAUGUA | 991 | 3337 | UACAUCUGCCAUUGUCAUG | 1214 |
| 3333 | AAAGUUAUUCUUGAAGUCA | 992 | 3333 | AAAGUUAUUCUUGAAGUCA | 992 | 3355 | UGACUUCAAGAAUAACUUU | 1215 |
| 3351 | AGAUUGAGGCUGGGAGACA | 993 | 3351 | AGAUUGAGGCUGGGAGACA | 993 | 3373 | UGUCUCCCAGCCUCAAUCU | 1216 |
| 3369 | AGCCGUAGUAGAUGUUCUA | 994 | 3369 | AGCCGUAGUAGAUGUUCUA | 994 | 3391 | UAGAACAUCUACUACGGCU | 1217 |
| 3387 | ACUUUGUUCUGCUGUUCUC | 995 | 3387 | ACUUUGUUCUGCUGUUCUC | 995 | 3409 | GAGAACAGCAGAACAAAGU | 1218 |
| 3405 | CUAGAAAGAAUAUUUGGUU | 996 | 3405 | CUAGAAAGAAUAUUUGGUU | 996 | 3427 | AACCAAAUAUUCUUUCUAG | 1219 |
| 3423 | UUUCCUGUAUAGGAAUGAG | 997 | 3423 | UUUCCUGUAUAGGAAUGAG | 997 | 3445 | CUCAUUCCUAUACAGGAAA | 1220 |
| 3441 | GAUUAAUUCCUUUCCAGGU | 998 | 3441 | GAUUAAUUCCUUUCCAGGU | 998 | 3463 | ACCUGGAAAGGAAUUAAUC | 1221 |
| 3459 | UAUUUUAUAAUUCUGGGAA | 999 | 3459 | UAUUUUAUAAUUCUGGGAA | 999 | 3481 | UUCCCAGAAUUAUAAAAUA | 1222 |
| 3477 | AGCAAAACCCAUGCCUCCC | 1000 | 3477 | AGCAAAACCCAUGCCUCCC | 1000 | 3499 | GGGAGGCAUGGGUUUUGCU | 1223 |
| 3495 | CCCUAGCCAUUUUACUGU | 1001 | 3495 | CCCUAGCCAUUUUACUGU | 1001 | 3517 | ACAGUAAAAUGGCUAGGG | 1224 |
| 3513 | UUAUCCUAUUUAGAUGGCC | 1002 | 3513 | UUAUCCUAUUUAGAUGGCC | 1002 | 3535 | GGCCAUCUAAAUAGGAUAA | 1225 |
| 3531 | CAUGAAGAGGAUGCUGUGA | 1003 | 3531 | CAUGAAGAGGAUGCUGUGA | 1003 | 3553 | UCACAGCAUCCUCUUCAUG | 1226 |
| 3549 | AAAUUCCCAACAAACAUUG | 1004 | 3549 | AAAUUCCCAACAAACAUUG | 1004 | 3571 | CAAUGUUUGUUGGGAAUUU | 1227 |
| 3567 | GAUGCUGACAGUCAUGCAG | 1005 | 3567 | GAUGCUGACAGUCAUGCAG | 1005 | 3589 | CUGCAUGACUGUCAGCAUC | 1228 |
| 3585 | GUCUGGGAGUGGGAAGUG | 1006 | 3585 | GUCUGGGAGUGGGAAGUG | 1006 | 3607 | CACUUCCCCACUCCCAGAC | 1229 |
| 3603 | GAUCUUUUGUUCCCAUCCU | 1007 | 3603 | GAUCUUUUGUUCCCAUCCU | 1007 | 3625 | AGGAUGGGAACAAAAGAUC | 1230 |
| 3621 | UCUUCUUUUAGCAGUAAAA | 1008 | 3621 | UCUUCUUUUAGCAGUAAAA | 1008 | 3643 | UUUUACUGCUAAAAGAAGA | 1231 |
| 3639 | AUAGCUGAGGGAAAAGGGA | 1009 | 3639 | AUAGCUGAGGGAAAAGGGA | 1009 | 3661 | UCCCUUUUCCCUCAGCUAU | 1232 |
| 3657 | AGGGAAAAGGAAGUUAUGG | 1010 | 3657 | AGGGAAAAGGAAGUUAUGG | 1010 | 3679 | CCAUAACUUCCUUUUCCCU | 1233 |
| 3675 | GGAAUACCUGUGGUGGUUG | 1011 | 3675 | GGAAUACCUGUGGUGGUUG | 1011 | 3697 | CAACCACCACAGGUAUUCC | 1234 |
| 3693 | GUGAUCCCUAGGUCUUGGG | 1012 | 3693 | GUGAUCCCUAGGUCUUGGG | 1012 | 3715 | CCCAAGACCUAGGGAUCAC | 1235 |
| 3711 | GAGCUCUUGGAGGUGUCUG | 1013 | 3711 | GAGCUCUUGGAGGUGUCUG | 1013 | 3733 | CAGACACCUCCAAGAGCUC | 1236 |
| 3729 | GUAUCAGUGGAUUUCCCAU | 1014 | 3729 | GUAUCAGUGGAUUUCCCAU | 1014 | 3751 | AUGGGAAAUCCACUGAUAC | 1237 |
| 3747 | UCCCCUGUGGGAAAUUAGU | 1015 | 3747 | UCCCCUGUGGGAAAUUAGU | 1015 | 3769 | ACUAAUUUCCCACAGGGGA | 1238 |
| 3765 | UAGGCUCAUUUACUGUUUU | 1016 | 3765 | UAGGCUCAUUUACUGUUUU | 1016 | 3787 | AAAACAGUAAAUGAGCCUA | 1239 |
| 3783 | UAGGUCUAGCCUAUGUGGA | 1017 | 3783 | UAGGUCUAGCCUAUGUGGA | 1017 | 3805 | UCCACAUAGGCUAGACCUA | 1240 |
| 3801 | AUUUUUUCCUAACAUACCU | 1018 | 3801 | AUUUUUUCCUAACAUACCU | 1018 | 3823 | AGGUAUGUUAGGAAAAAAU | 1241 |
| 3819 | UAAGCAAACCCAGUGUCAG | 1019 | 3819 | UAAGCAAACCCAGUGUCAG | 1019 | 3841 | CUGACACUGGGUUUGCUUA | 1242 |
| 3837 | GGAUGGUAAUUCUUAUUCU | 1020 | 3837 | GGAUGGUAAUUCUUAUUCU | 1020 | 3859 | AGAAUAAGAAUUACCAUCC | 1243 |
| 3855 | UUUCGUUCAGUUAAGUUUU | 1021 | 3855 | UUUCGUUCAGUUAAGUUUU | 1021 | 3877 | AAAACUUAACUGAACGAAA | 1244 |
| 3873 | UUCCCUUCAUCUGGGCACU | 1022 | 3873 | UUCCCUUCAUCUGGGCACU | 1022 | 3895 | AGUGCCCAGAUGAAGGGAA | 1245 |
| 3891 | UGAAGGGAUAUGUGAAACA | 1023 | 3891 | UGAAGGGAUAUGUGAAACA | 1023 | 3913 | UGUUUCACAUAUCCCUUCA | 1246 |
| 3909 | AAUGUUAACAUUUUGGUA | 1024 | 3909 | AAUGUUAACAUUUUGGUA | 1024 | 3931 | UACCAAAAAUGUUAACAUU | 1247 |
| 3927 | AGUCUUCAACCAGGGAUUG | 1025 | 3927 | AGUCUUCAACCAGGGAUUG | 1025 | 3949 | CAAUCCCUGGUUGAAGACU | 1248 |
| 3945 | GUUUCUGUUUAACUUCUUA | 1026 | 3945 | GUUUCUGUUUAACUUCUUA | 1026 | 3967 | UAAGAAGUUAAACAGAAAC | 1249 |
| 3963 | AUAGGAAAGCUUGAGUAAA | 1027 | 3963 | AUAGGAAAGCUUGAGUAAA | 1027 | 3985 | UUUACUCAAGCUUUCCUAU | 1250 |

TABLE II-continued

Interleukin and Interleukin receptor siNA and Target Sequences

| Pos | Seq | Seq ID | UPos | Upper seq | Seq ID | LPos | Lower seq | Seq ID |
|---|---|---|---|---|---|---|---|---|
| 3981 | AAUAAAUAUUGUCUUUUUG | 1028 | 3981 | AAUAAAUAUUGUCUUUUUG | 1028 | 4003 | CAAAAAGACAAUAUUUAUU | 1251 |
| 3986 | AUAUUGUCUUUUUGUAUGU | 1029 | 3986 | AUAUUGUCUUUUUGUAUGU | 1029 | 4008 | ACAUACAAAAAGACAAUAU | 1252 |

The 3'-ends of the Upper sequence and the Lower sequence of the siNA construct can include an overhang sequence, for example about 1, 2, 3, or 4 nucleotides in length, preferably 2 nucleotides in length, wherein the overhanging sequence of the lower sequence is optionally complementary to a portion of the target sequence. The upper sequence is also referred to as the sense strand, whereas the lower sequence is also referred to as the antisense strand. The upper and lower sequences in the Table can further comprise a chemical modification having Formulae I-VII or any combination thereof.

TABLE III

Interleukin and Interleukin receptor Synthetic Modified siNA constructs

| Target Pos | Target | Seq ID | Cmpd# | Aliases | Sequence | Seq ID |
|---|---|---|---|---|---|---|
| | | | IL2RG | | | |
| 118 | ACACCACAGCUGAUUUCUUCCUG | 1253 | | IL2RG:120U21 sense siNA | ACCACAGCUGAUUUCUUCCTT | 1311 |
| 130 | AUUUCUUCCUGACCACUAUGCCC | 1254 | | IL2RG:132U21 sense siNA | UUCUUCCUGACCACUAUGCTT | 1312 |
| 138 | CUGACCACUAUGCCCACUGACUC | 1255 | | IL2RG:140U21 sense siNA | GACCACUAUGCCCACUGACTT | 1313 |
| 155 | UGACUCCCUCAGUGUUUCCACUC | 1256 | | IL2RG:157U21 sense siNA | ACUCCCUCAGUGUUUCCACTT | 1314 |
| 262 | CCAACCUCACUCUGCAUUAUUGG | 1257 | | IL2RG:264U21 sense siNA | AACCUCACUCUGCAUUAUUTT | 1315 |
| 302 | UGAUAAAGUCCAGAAGUGCAGCC | 1258 | | IL2RG:304U21 sense siNA | AUAAAGUCCAGAAGUGCAGTT | 1316 |
| 303 | GAUAAAGUCCAGAAGUGCAGCCA | 1259 | | IL2RG:305U21 sense siNA | UAAAGUCCAGAAGUGCAGCTT | 1317 |
| 344 | AAUCACUUCGGCUGUCAGUUGC | 1260 | | IL2RG:346U21 sense siNA | UCACUUCGGCUGUCAGUUTT | 1318 |
| 118 | ACACCACAGCUGAUUUCUUCCUG | 1253 | | IL2RG:138L21 antisense siNA (120C) | GGAAGAAAUCAGCUGUGGUTT | 1319 |
| 130 | AUUUCUUCCUGACCACUAUGCCC | 1254 | | IL2RG:150L21 antisense siNA (132C) | GCAUAGUGGUCAGGAAGAATT | 1320 |
| 138 | CUGACCACUAUGCCCACUGACUC | 1255 | | IL2RG:158L21 antisense siNA (140C) | GUCAGUGGGCAUAGUGGUCTT | 1321 |
| 155 | UGACUCCCUCAGUGUUUCCACUC | 1256 | | IL2RG:175L21 antisense siNA (157C) | GUGGAAACACUGAGGGAGUTT | 1322 |
| 262 | CCAACCUCACUCUGCAUUAUUGG | 1257 | | IL2RG:282L21 antisense siNA (264C) | AAUAAUGCAGAGUGAGGUUTT | 1323 |
| 302 | UGAUAAAGUCCAGAAGUGCAGCC | 1258 | | IL2RG:322L21 antisense siNA (304C) | CUGCACUUCUGGACUUUAUTT | 1324 |
| 303 | GAUAAAGUCCAGAAGUGCAGCCA | 1259 | | IL2RG:323L21 antisense siNA (305C) | GCUGCACUUCUGGACUUUATT | 1325 |
| 344 | AAUCACUUCGGCUGUCAGUUGC | 1260 | | IL2RG:364L21 antisense siNA (346C) | AACUGACAGCCAGAAGUGATT | 1326 |
| 118 | ACACCACAGCUGAUUUCUUCCUG | 1253 | | IL2RG:120U21 sense siNA stab04 | B AccAcAGcuGAuuucuuccTT B | 1327 |
| 130 | AUUUCUUCCUGACCACUAUGCCC | 1254 | | IL2RG:132U21 sense siNA stab04 | B uucuuccuGAccAcuAuGcTT B | 1328 |
| 138 | CUGACCACUAUGCCCACUGACUC | 1255 | | IL2RG:140U21 sense siNA stab04 | B GAccAcuAuGcccAcuGAcTT B | 1329 |
| 155 | UGACUCCCUCAGUGUUUCCACUC | 1256 | | IL2RG:157U21 sense siNA stab04 | B AcucccucAGuGuuuccAcTT B | 1330 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 262 | CCAACCUCACUCUGCAUUAUUGG | 1257 | | IL2RG:264U21 sense siNA stab04 | B AAccucAcucuGcAuuAuuTT B | 1331 |
| 302 | UGAUAAAGUCCAGAAGUGCAGCC | 1258 | | IL2RG:304U21 sense siNA stab04 | B AuAAAGuccAGAAGuGcAGTT B | 1332 |
| 303 | GAUAAAGUCCAGAAGUGCAGCCA | 1259 | | IL2RG:305U21 sense siNA stab04 | B uAAAGuccAGAAGuGcAGcTT B | 1333 |
| 344 | AAUCACUUCUGGCUGUCAGUUGC | 1260 | | IL2RG:346U21 sense siNA stab04 | B ucAcuucuGGcuGucAGuuTT B | 1334 |
| 118 | ACACCACAGCUGAUUUCUUCCUG | 1253 | | IL2RG:138L21 antisense siNA (120C) stab05 | GGAAGAAucAGcuGuGGuTsT | 1335 |
| 130 | AUUUCUUCCUGACCACUAUGCCC | 1254 | | IL2RG:150L21 antisense siNA (132C) stab05 | GcAuAGuGGucAGGAAGAATsT | 1336 |
| 138 | CUGACCACUAUGCCCACUGACUC | 1255 | | IL2RG:158L21 antisense siNA (140C) stab05 | GucAGuGGGcAuAGuGGucTsT | 1337 |
| 155 | UGACUCCCUCAGUGUUUCCACUC | 1256 | | IL2RG:175L21 antisense siNA (157C) stab05 | GuGGAAAcAcuGAGGGAGuTsT | 1338 |
| 262 | CCAACCUCACUCUGCAUUAUUGG | 1257 | | IL2RG:282L21 antisense siNA (264C) stab05 | AAuAAuGcAGAGuGAGGuuTsT | 1339 |
| 302 | UGAUAAAGUCCAGAAGUGCAGCC | 1258 | | IL2RG:322L21 antisense siNA (304C) stab05 | cuGcAcuucuGGAcuuuAuTsT | 1340 |
| 303 | GAUAAAGUCCAGAAGUGCAGCCA | 1259 | | IL2RG:323L21 antisense siNA (305C) stab05 | GcuGcAcuucuGGAcuuuATsT | 1341 |
| 344 | AAUCACUUCUGGCUGUCAGUUGC | 1260 | | IL2RG:364L21 antisense siNA (346C) stab05 | AAcuGAcAGccAGAAGuGATsT | 1342 |
| 118 | ACACCACAGCUGAUUUCUUCCUG | 1253 | | IL2RG:120U21 sense siNA stab07 | B AccAcAGcuGAuuucuuccTT B | 1343 |
| 130 | AUUUCUUCCUGACCACUAUGCCC | 1254 | | IL2RG:132U21 sense siNA stab07 | B uucuuccuGAccAcuAuGcTT B | 1344 |
| 138 | CUGACCACUAUGCCCACUGACUC | 1255 | | IL2RG:140U21 sense siNA stab07 | B GAccAcuAuGcccAcuGAcTT B | 1345 |
| 155 | UGACUCCCUCAGUGUUUCCACUC | 1256 | | IL2RG:157U21 sense siNA stab07 | B AcucccucAGuGuuuccAcTT B | 1346 |
| 262 | CCAACCUCACUCUGCAUUAUUGG | 1257 | | IL2RG:264U21 sense siNA stab07 | B AAccucAcucuGcAuuAuuTT B | 1347 |
| 302 | UGAUAAAGUCCAGAAGUGCAGCC | 1258 | | IL2RG:304U21 sense siNA stab07 | B AuAAAGuccAGAAGuGcAGTT B | 1348 |
| 303 | GAUAAAGUCCAGAAGUGCAGCCA | 1259 | | IL2RG:305U21 sense siNA stab07 | B uAAAGuccAGAAGuGcAGcTT B | 1349 |
| 344 | AAUCACUUCUGGCUGUCAGUUGC | 1260 | | IL2RG:346U21 sense siNA stab07 | B ucAcuucuGGcuGucAGuuTT B | 1350 |
| 118 | ACACCACAGCUGAUUUCUUCCUG | 1253 | | IL2RG:138L21 antisense siNA (120C) stab11 | GGAAGAAucAGcuGuGGuTsT | 1351 |
| 130 | AUUUCUUCCUGACCACUAUGCCC | 1254 | | IL2RG:150L21 antisense siNA (132C) stab11 | GcAuAGuGGucAGGAAGAATsT | 1352 |
| 138 | CUGACCACUAUGCCCACUGACUC | 1255 | | IL2RG:158L21 antisense siNA (140C) stab11 | GucAGuGGGcAuAGuGGucTsT | 1353 |
| 155 | UGACUCCCUCAGUGUUUCCACUC | 1256 | | IL2RG:175L21 antisense siNA (157C) stab11 | GuGGAAAcAcuGAGGGAGuTsT | 1354 |
| 262 | CCAACCUCACUCUGCAUUAUUGG | 1257 | | IL2RG:282L21 antisense siNA (264C) stab11 | AAuAAuGcAGAGuGAGGuuTsT | 1355 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 302 | UGAUAAAGUCCAGAAGUGCAGCC | 1258 | | IL2RG:322L21 antisense siNA (304C) stab11 | cuGcAcuucuGGAcuuuAuTsT | 1356 |
| 303 | GAUAAAGUCCAGAAGUGCAGCCA | 1259 | | IL2RG:323L21 antisense siNA (305C) stab11 | GcuGcAcuucuGGAcuuuATsT | 1357 |
| 344 | AAUCACUUCUGGCUGUCAGUUGC | 1260 | | IL2RG:364L21 antisense siNA (346C) stab11 | AAcuGAcAGccAGAAGuGATsT | 1358 |
| 118 | ACACCACAGCUGAUUUCUUCCUG | 1253 | | IL2RG:120U21 sense siNA stab18 | B AccAcAGcuGAuuucuuccTT B | 1359 |
| 130 | AUUUCUUCCUGACCACUAUGCCC | 1254 | | IL2RG:132U21 sense siNA stab18 | B uucuuccuGAccAcuAuGcTT B | 1360 |
| 138 | CUGACCACUAUGCCCACUGACUC | 1255 | | IL2RG:140U21 sense siNA stab18 | B GAccAcuAuGcccAcuGAcTT B | 1361 |
| 155 | UGACUCCCUCAGUGUUUCCACUC | 1256 | | IL2RG:157U21 sense siNA stab18 | B AcucccucAGuGuuuccAcTT B | 1362 |
| 262 | CCAACCUCACUCUGCAUUAUUGG | 1257 | | IL2RG:264U21 sense siNA stab18 | B AAccucAcucuGcAuuAuuTT B | 1363 |
| 302 | UGAUAAAGUCCAGAAGUGCAGCC | 1258 | | IL2RG:304U21 sense siNA stab18 | B AuAAAGuccAGAAGUuGcAGTT B | 1364 |
| 303 | GAUAAAGUCCAGAAGUGCAGCCA | 1259 | | IL2RG:305U21 sense siNA stab18 | B uAAAGuccAGAAGuGcAGcTT B | 1365 |
| 344 | AAUCACUUCUGGCUGUCAGUUGC | 1260 | | IL2RG:346U21 sense siNA stab18 | B ucAcuucuGGcuGucAGuuTT B | 1366 |
| 118 | ACACCACAGCUGAUUUCUUCCUG | 1253 | | IL2RG:138L21 antisense siNA (120C) stab08 | GGAAGAAAucAGcuGuGGuTsT | 1367 |
| 130 | AUUUCUUCCUGACCACUAUGCCC | 1254 | | IL2RG:150L21 antisense siNA (132C) stab08 | GcAuAGuGGucAGGAAGAATsT | 1368 |
| 138 | CUGACCACUAUGCCCACUGACUC | 1255 | | IL2RG:158L21 antisense siNA (140C) stab08 | GucAGuGGGcAuAGuGGucTsT | 1369 |
| 155 | UGACUCCCUCAGUGUUUCCACUC | 1256 | | IL2RG:175L21 antisense siNA (157C) stab08 | GuGGAAAcAcuGAGGGAGuTsT | 1370 |
| 262 | CCAACCUCACUCUGCAUUAUUGG | 1257 | | IL2RG:282L21 antisense siNA (264C) stab08 | AAuAAuGcAGAGuGAGGuuTsT | 1371 |
| 302 | UGAUAAAGUCCAGAAGUGCAGCC | 1258 | | IL2RG:322L21 antisense siNA (304C) stab08 | cuGcAcuucuGGAcuuuAuTsT | 1372 |
| 303 | GAUAAAGUCCAGAAGUGCAGCCA | 1259 | | IL2RG:323L21 antisense siNA (305C) stab08 | GcuGcAcuucuGGAcuuuATsT | 1373 |
| 344 | AAUCACUUCUGGCUGUCAGUUGC | 1260 | | IL2RG:364L21 antisense siNA (346C) stab08 | AAcuGAcAGccAGAAGuGATsT | 1374 |
| 118 | ACACCACAGCUGAUUUCUUCCUG | 1253 | | IL2RG:120U21 sense siNA stab09 | B ACCACAGCUGAUUUCUUCCTT B | 1375 |
| 130 | AUUUCUUCCUGACCACUAUGCCC | 1254 | | IL2RG:132U21 sense siNA stab09 | B UUCUUCCUGACCACUAUGCTT B | 1376 |
| 138 | CUGACCACUAUGCCCACUGACUC | 1255 | | IL2RG:140U21 sense siNA stab09 | B GACCACUAUGCCCACUGACTT B | 1377 |
| 155 | UGACUCCCUCAGUGUUUCCACUC | 1256 | | IL2RG:157U21 sense siNA stab09 | B ACUCCCUCAGUGUUUCCACTT B | 1378 |
| 262 | CCAACCUCACUCUGCAUUAUUGG | 1257 | | IL2RG:264U21 sense siNA stab09 | B AACCUCACUCUGCAUUAUUTT B | 1379 |
| 302 | UGAUAAAGUCCAGAAGUGCAGCC | 1258 | | IL2RG:304U21 sense siNA stab09 | B AUAAAGUCCAGAAGUGCAGTT B | 1380 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 303 | GAUAAAGUCCAGAAGUGCAGCCA | 1259 | | IL2RG:305U21 sense siNA stab09 | B UAAAGUCCAGAAGUGCAGCTT B | 1381 |
| 344 | AAUCACUUCUGGCUGUCAGUUGC | 1260 | | IL2RG:346U21 sense siNA stab09 | B UCACUUCUGGCUGUCAGUUTT B | 1382 |
| 118 | ACACCACAGCUGAUUUCUUCCUG | 1253 | | IL2RG:138L21 antisense siNA (120C) stab10 | GGAAGAAAUCAGCUGUGGUTsT | 1383 |
| 130 | AUUUCUUCCUGACCACUAUGCCC | 1254 | | IL2RG:150L21 antisense siNA (132C) stab10 | GCAUAGUGGUCAGGAAGAAUTsT | 1384 |
| 138 | CUGACCACUAUGCCCACUGACUC | 1255 | | IL2RG:158L21 antisense siNA (140C) stab10 | GUCAGUGGGCAUAGUGGUCTsT | 1385 |
| 155 | UGACUCCCUCAGUGUUUCCACUC | 1256 | | IL2RG:175L21 antisense siNA (157C) stab10 | GUGGAAACACUGAGGGAGUTsT | 1386 |
| 262 | CCAACCUCACUCUGCAUUAUUGG | 1257 | | IL2RG:282L21 antisense siNA (264C) stab10 | AAUAAUGCAGAGUGAGGUUTsT | 1387 |
| 302 | UGAUAAAGUCCAGAAGUGCAGCC | 1258 | | IL2RG:322L21 antisense siNA (304C) stab10 | CUGCACUUCUGGACUUUAUTsT | 1388 |
| 303 | GAUAAAGUCCAGAAGUGCAGCCA | 1259 | | IL2RG:323L21 antisense siNA (305C) stab10 | GCUGCACUUCUGGACUUUATsT | 1389 |
| 344 | AAUCACUUCUGGCUGUCAGUUGC | 1260 | | IL2RG:364L21 antisense siNA (346C) stab10 | AACUGACAGCCAGAAGUGATsT | 1390 |
| 118 | ACACCACAGCUGAUUUCUUCCUG | 1253 | | IL2RG:138L21 antisense siNA (120C) stab19 | GGAAGAAAucAGcuGuGGuTT B | 1391 |
| 130 | AUUUCUUCCUGACCACUAUGCCC | 1254 | | IL2RG:150L21 antisense siNA (132C) stab19 | GcAuAGuGGucAGGAAGAATT B | 1392 |
| 138 | CUGACCACUAUGCCCACUGACUC | 1255 | | IL2RG:158L21 antisense siNA (140C) stab19 | GucAGuGGGcAuAGuGGucTT B | 1393 |
| 155 | UGACUCCCUCAGUGUUUCCACUC | 1256 | | IL2RG:175L21 antisense siNA (157C) stab19 | GuGGAAAcAcuGAGGGAGuTT B | 1394 |
| 262 | CCAACCUCACUCUGCAUUAUUGG | 1257 | | IL2RG:282L21 antisense siNA (264C) stab19 | AAuAAuGcAGAGuGAGGuuTT B | 1395 |
| 302 | UGAUAAAGUCCAGAAGUGCAGCC | 1258 | | IL2RG:322L21 antisense siNA (304C) stab19 | cuGcAcuucuGGAcuuuAuTT B | 1396 |
| 303 | GAUAAAGUCCAGAAGUGCAGCCA | 1259 | | IL2RG:323L21 antisense siNA (305C) stab19 | GcuGcAcuucuGGAcuuuATT B | 1397 |
| 344 | AAUCACUUCUGGCUGUCAGUUGC | 1260 | | IL2RG:364L21 antisense siNA (346C) stab19 | AAcuGAcAGccAGAAGuGATT B | 1398 |
| 118 | ACACCACAGCUGAUUUCUUCCUG | 1253 | | IL2RG:138L21 antisense siNA (120C) stab22 | GGAAGAAAUCAGCUGUGGUTT B | 1399 |
| 130 | AUUUCUUCCUGACCACUAUGCCC | 1254 | | IL2RG:150L21 antisense siNA (132C) stab22 | GCAUAGUGGUCAGGAAGAAUTT B | 1400 |
| 138 | CUGACCACUAUGCCCACUGACUC | 1255 | | IL2RG:158L21 antisense siNA (140C) stab22 | GUCAGUGGGCAUAGUGGUCTT B | 1401 |
| 155 | UGACUCCCUCAGUGUUUCCACUC | 1256 | | IL2RG:175L21 antisense siNA (157C) stab22 | GUGGAAACACUGAGGGAGUTT B | 1402 |
| 262 | CCAACCUCACUCUGCAUUAUUGG | 1257 | | IL2RG:282L21 antisense siNA (264C) stab22 | AAUAAUGCAGAGUGAGGUUTT B | 1403 |
| 302 | UGAUAAAGUCCAGAAGUGCAGCC | 1258 | | IL2RG:322L21 antisense siNA (304C) stab22 | CUGCACUUCUGGACUUUAUTT B | 1404 |
| 303 | GAUAAAGUCCAGAAGUGCAGCCA | 1259 | | IL2RG:323L21 antisense siNA (305C) stab22 | GCUGCACUUCUGGACUUUATT B | 1405 |

TABLE III-continued

Interleukin and Interleukin receptor Synthetic Modified siNA constructs

| Target Pos | Target | Seq ID | Cmpd# Aliases | Sequence | Seq ID |
|---|---|---|---|---|---|
| 344 | AAUCACUUCUGGCUGUCAGUUGC | 1260 | IL2RG:364L21 antisense siNA (346C) stab22 | AACUGACAGCCAGAAGUGATT B | 1406 |
| | | | IL4 | | |
| 487 | CAGCCUCACAGAGCAGAAGACUC | 1269 | IL4:489U21 sense siNA | GCCUCACAGAGCAGAAGACTT | 1407 |
| 489 | GCCUCACAGAGCAGAAGACUCUG | 1270 | IL4:491U21 sense siNA | CUCACAGAGCAGAAGACUCTT | 1408 |
| 516 | CCGAGUUGACCGUAACAGACAUC | 1271 | IL4:518U21 sense siNA | GAGUUGACCGUAACAGACATT | 1409 |
| 526 | CGUAACAGACAUCUUUGCUGCCU | 1272 | IL4:528U21 sense siNA | UAACAGACAUCUUUGCUGCTT | 1410 |
| 545 | GCCUCCAAGAACACAACUGAGAA | 1273 | IL4:547U21 sense siNA | CUCCAAGAACACAACUGAGTT | 1411 |
| 606 | UCUACAGCCACCAUGAGAAGGAC | 1274 | IL4:608U21 sense siNA | UACAGCCACCAUGAGAAGGTT | 1412 |
| 728 | UUGAAUUCCUGUCCUGUGAAGGA | 1275 | IL4:730U21 sense siNA | GAAUUCCUGUCCUGUGAAGTT | 1413 |
| 745 | GAAGGAAGCCAACCAGAGUACGU | 1276 | IL4:747U21 sense siNA | AGGAAGCCAACCAGAGUACTT | 1414 |
| 487 | CAGCCUCACAGAGCAGAAGACUC | 1269 | IL4:507L21 antisense siNA (489C) | GUCUUCUGCUCUGUGAGGCTT | 1415 |
| 489 | GCCUCACAGAGCAGAAGACUCUG | 1270 | IL4:509L21 antisense siNA (491C) | GAGUCUUCUGCUCUGUGAGTT | 1416 |
| 516 | CCGAGUUGACCGUAACAGACAUC | 1271 | IL4:536L21 antisense siNA (518C) | UGUCUGUUACGGUCAACUCTT | 1417 |
| 526 | CGUAACAGACAUCUUUGCUGCCU | 1272 | IL4:546L21 antisense siNA (528C) | GCAGCAAAGAUGUCUGUUATT | 1418 |
| 545 | GCCUCCAAGAACACAACUGAGAA | 1273 | IL4:565L21 antisense siNA (547C) | CUCAGUUGUGUUCUUGGAGTT | 1419 |
| 606 | UCUACAGCCACCAUGAGAAGGAC | 1274 | IL4:626L21 antisense siNA (608C) | CCUUCUCAUGGUGGCUGUATT | 1420 |
| 728 | UUGAAUUCCUGUCCUGUGAAGGA | 1275 | IL4:748L21 antisense siNA (730C) | CUUCACAGGACAGGAAUUCTT | 1421 |
| 745 | GAAGGAAGCCAACCAGAGUACGU | 1276 | IL4:765L21 antisense siNA (747C) | GUACUCUGGUUGGCUUCCUTT | 1422 |
| 487 | CAGCCUCACAGAGCAGAAGACUC | 1269 | IL4:489U21 sense siNA stab04 | B GccucAcAGAGcAGAAGAcTT B | 1423 |
| 489 | GCCUCACAGAGCAGAAGACUCUG | 1270 | IL4:491U21 sense siNA stab04 | B cucAcAGAGcAGAAGAcucTT B | 1424 |
| 516 | CCGAGUUGACCGUAACAGACAUC | 1271 | IL4:518U21 sense siNA stab04 | B GAGuuGAccGuAAcAGAcATT B | 1425 |
| 526 | CGUAACAGACAUCUUUGCUGCCU | 1272 | IL4:528U21 sense siNA stab04 | B uAAcAGAcAucuuuGcuGcTT B | 1426 |
| 545 | GCCUCCAAGAACACAACUGAGAA | 1273 | IL4:547U21 sense siNA stab04 | B cuccAAGAAcAcAAcuGAGTT B | 1427 |
| 606 | UCUACAGCCACCAUGAGAAGGAC | 1274 | IL4:608U21 sense siNA stab04 | B uAcAGccAccAuGAGAAGGTT B | 1428 |
| 728 | UUGAAUUCCUGUCCUGUGAAGGA | 1275 | IL4:730U21 sense siNA stab04 | B GAAuuccuGuccuGuGAAGTT B | 1429 |
| 745 | GAAGGAAGCCAACCAGAGUACGU | 1276 | IL4:747U21 sense siNA stab04 | B AGGAAGccAAccAGAGuAcTT B | 1430 |
| 487 | CAGCCUCACAGAGCAGAAGACUC | 1269 | IL4:507L21 antisense siNA (489C) stab05 | GucuucuGcucuGuGAGGcTsT | 1431 |
| 489 | GCCUCACAGAGCAGAAGACUCUG | 1270 | IL4:509L21 antisense siNA (491C) stab05 | GAGucuucuGcucuGuGAGTsT | 1432 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 516 | CCGAGUUGACCGUAACAGACAUC | 1271 | | IL4:536L21 antisense siNA (518C) stab05 | uGucuGuuAcGGucAAcucTsT | 1433 |
| 526 | CGUAACAGACAUCUUUGCUGCCU | 1272 | | IL4:546L21 antisense siNA (528C) stab05 | GcAGcAAAGAuGucuGuuATsT | 1434 |
| 545 | GCCUCCAAGAACACAACUGAGAA | 1273 | | IL4:565L21 antisense siNA (547C) stab05 | cucAGuuGuGuucuuGGAGTsT | 1435 |
| 606 | UCUACAGCCACCAUGAGAAGGAC | 1274 | | IL4:626L21 antisense siNA (608C) stab05 | ccuucucAuGGuGGcuGuATsT | 1436 |
| 728 | UUGAAUUCCUGUCCUGUGAAGGA | 1275 | | IL4:748L21 antisense siNA (730C) stab05 | cuucAcAGGAcAGGAAuucTsT | 1437 |
| 745 | GAAGGAAGCCAACCAGAGUACGU | 1276 | | IL4:765L21 antisense siNA (747C) stab05 | GuAcucuGGuuGGcuuccuTsT | 1438 |
| 487 | CAGCCUCACAGAGCAGAAGACUC | 1269 | | IL4:489U21 sense siNA stab07 | B GccucAcAGAGcAGAAGAcTT B | 1439 |
| 489 | GCCUCACAGAGCAGAAGACUCUG | 1270 | | IL4:491U21 sense siNA stab07 | B cucAcAGAGcAGAAGAcucTT B | 1440 |
| 516 | CCGAGUUGACCGUAACAGACAUC | 1271 | | IL4:518U21 sense siNA stab07 | B GAGuuGAccGuAAcAGAcATT B | 1441 |
| 526 | CGUAACAGACAUCUUUGCUGCCU | 1272 | | IL4:528U21 sense siNA stab07 | B uAAcAGAcAucuuuGcuGcTT B | 1442 |
| 545 | GCCUCCAAGAACACAACUGAGAA | 1273 | | IL4:547U21 sense siNA stab07 | B cuccAAGAAcAcAAcuGAGTT B | 1443 |
| 606 | UCUACAGCCACCAUGAGAAGGAC | 1274 | | IL4:608U21 sense siNA stab07 | B uAcAGccAccAuGAGAAGGTT B | 1444 |
| 728 | UUGAAUUCCUGUCCUGUGAAGGA | 1275 | | IL4:730U21 sense siNA stab07 | B GAAuccuGuccuGuGAAGTT B | 1445 |
| 745 | GAAGGAAGCCAACCAGAGUACGU | 1276 | | IL4:747U21 sense siNA stab07 | B AGGAAGccAAccAGAGuAcTT B | 1446 |
| 487 | CAGCCUCACAGAGCAGAAGACUC | 1269 | | IL4:507L21 antisense siNA (489C) stab11 | GucuucuGcucuGuGAGGcTsT | 1447 |
| 489 | GCCUCACAGAGCAGAAGACUCUG | 1270 | | IL4:509L21 antisense siNA (491C) stab11 | GAGucuucuGcucuGuGAGTsT | 1448 |
| 516 | CCGAGUUGACCGUAACAGACAUC | 1271 | | IL4:536L21 antisense siNA (518C) stab11 | uGucuGuuAcGGucAAcucTsT | 1449 |
| 526 | CGUAACAGACAUCUUUGCUGCCU | 1272 | | IL4:546L21 antisense siNA (528C) stab11 | GcAGcAAAGAuGucuGuuATsT | 1450 |
| 545 | GCCUCCAAGAACACAACUGAGAA | 1273 | | IL4:565L21 antisense siNA (547C) stab11 | cucAGuuGuGuucuuGGAGTsT | 1451 |
| 606 | UCUACAGCCACCAUGAGAAGGAC | 1274 | | IL4:626L21 antisense siNA (608C) stab11 | ccuucucAuGGuGGcuGuATsT | 1452 |
| 728 | UUGAAUUCCUGUCCUGUGAAGGA | 1275 | | IL4:748L21 antisense siNA (730C) stab11 | cuucAcAGGAcAGGAAuucTsT | 1453 |
| 745 | GAAGGAAGCCAACCAGAGUACGU | 1276 | | IL4:765L21 antisense siNA (747C) stab11 | GuAcucuGGuuGGcuuccuTsT | 1454 |
| 487 | CAGCCUCACAGAGCAGAAGACUC | 1269 | | IL4:489U21 sense siNA stab18 | B GccucAcAGAGcAGAAGAcTT B | 1455 |
| 489 | GCCUCACAGAGCAGAAGACUCUG | 1270 | | IL4:491U21 sense siNA stab18 | B cucAcAGAGcAGAAGAcucTT B | 1456 |
| 516 | CCGAGUUGACCGUAACAGACAUC | 1271 | | IL4:518U21 sense siNA stab18 | B GAGuuGAccGuAAcAGAcATT B | 1457 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 526 | CGUAACAGACAUCUUUGCUGCCU | 1272 | | IL4:528U21 sense siNA stab18 | B uAAcAGAcAucuuuGcuGcTT B | 1458 |
| 545 | GCCUCCAAGAACACAACUGAGAA | 1273 | | IL4:547U21 sense siNA stab18 | B cuccAAGAAcAcAAcuGAGTT B | 1459 |
| 606 | UCUACAGCCACCAUGAGAAGGAC | 1274 | | IL4:608U21 sense siNA stab18 | B uAcAGccAccAuGAGAAGGTT B | 1460 |
| 728 | UUGAAUUCCUGUCCUGUGAAGGA | 1275 | | IL4:730U21 sense siNA stab18 | B GAAuccuGuccuGuGAAGTT B | 1461 |
| 745 | GAAGGAAGCCAACCAGAGUACGU | 1276 | | IL4:747U21 sense siNA stab18 | B AGGAAGccAAccAGAGuAcTT B | 1462 |
| 487 | CAGCCUCACAGAGCAGAAGACUC | 1269 | | IL4:507L21 antisense siNA (489C) stab08 | GucuucuGcucuGuGAGGcTsT | 1463 |
| 489 | GCCUCACAGAGCAGAAGACUCUG | 1270 | | IL4:509L21 antisense siNA (491C) stab08 | GAGucuucuGcucuGuGAGTsT | 1464 |
| 516 | CCGAGUUGACCGUAACAGACAUC | 1271 | | IL4:536L21 antisense siNA (518C) stab08 | uGucuGuuAcGGucAAcucTsT | 1465 |
| 526 | CGUAACAGACAUCUUUGCUGCCU | 1272 | | IL4:546L21 antisense siNA (528C) stab08 | GcAGcAAAGAuGucuGuuATsT | 1466 |
| 545 | GCCUCCAAGAACACAACUGAGAA | 1273 | | IL4:565L21 antisense siNA (547C) stab08 | cucAGuuGuGuucuuGGAGTsT | 1467 |
| 606 | UCUACAGCCACCAUGAGAAGGAC | 1274 | | IL4:626L21 antisense siNA (608C) stab08 | ccuucucAuGGuGGcuGuATsT | 1468 |
| 728 | UUGAAUUCCUGUCCUGUGAAGGA | 1275 | | IL4:748L21 antisense siNA (730C) stabo8 | cuucAcAGGAcAGGAAuucTsT | 1469 |
| 745 | GAAGGAAGCCAACCAGAGUACGU | 1276 | | IL4:765L21 antisense siNA (747C) stab08 | GuAcucuGGuuGGcuuccuTsT | 1470 |
| 487 | CAGCCUCACAGAGCAGAAGACUC | 1269 | | IL4:489U21 sense siNA stab09 | B GCCUCACAGAGCAGAAGACTT B | 1471 |
| 489 | GCCUCACAGAGCAGAAGACUCUG | 1270 | | IL4:491U21 sense siNA stab09 | B CUCACAGAGCAGAAGACUCTT B | 1472 |
| 516 | CCGAGUUGACCGUAACAGACAUC | 1271 | | IL4:518U21 sense siNA stab09 | B GAGUUGACCGUAACAGACATT B | 1473 |
| 526 | CGUAACAGACAUCUUUGCUGCCU | 1272 | | IL4:528U21 sense siNA stab09 | B UAACAGACAUCUUUGCUGCTT B | 1474 |
| 545 | GCCUCCAAGAACACAACUGAGAA | 1273 | | IL4:547U21 sense siNA stab09 | B CUCCAAGAACACAACUGAGTT B | 1475 |
| 606 | UCUACAGCCACCAUGAGAAGGAC | 1274 | | IL4:608U21 sense siNA stab09 | B UACAGCCACCAUGAGAAGGTT B | 1476 |
| 728 | UUGAAUUCCUGUCCUGUGAAGGA | 1275 | | IL4:730U21 sense siNA stab09 | B GAAUUCCUGUCCUGUGAAGTT B | 1477 |
| 745 | GAAGGAAGCCAACCAGAGUACGU | 1276 | | IL4:747U21 sense siNA stab09 | B AGGAAGCCAACCAGAGUACTT B | 1478 |
| 487 | CAGCCUCACAGAGCAGAAGACUC | 1269 | | IL4:507L21 antisense siNA (489C) stab10 | GUCUUCUGCUCUGUGAGGCTsT | 1479 |
| 489 | GCCUCACAGAGCAGAAGACUCUG | 1270 | | IL4:509L21 antisense siNA (491C) stab10 | GAGUCUUCUGCUCUGUGAGTsT | 1480 |
| 516 | CCGAGUUGACCGUAACAGACAUC | 1271 | | IL4:536L21 antisense siNA (518C) stab10 | UGUCUGUUACGGUCAACUCTsT | 1481 |
| 526 | CGUAACAGACAUCUUUGCUGCCU | 1272 | | IL4:546L21 antisense siNA (528C) stab10 | GCAGCAAAGAUGUCUGUUATsT | 1482 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 545 | GCCUCCAAGAACACAACUGAGAA | 1273 | IL4:565L21 antisense siNA (547C) stab10 | | CUCAGUUGUGUUCUUGGAGTsT | 1483 |
| 606 | UCUACAGCCACCAUGAGAAGGAC | 1274 | IL4:626L21 antisense siNA (608C) stab10 | | CCUUCUCAUGGUGGCUGUATsT | 1484 |
| 728 | UUGAAUUCCUGUCCUGUGAAGGA | 1275 | IL4:748L21 antisense siNA (730C) stab10 | | CUUCACAGGACAGGAAUUCTsT | 1485 |
| 745 | GAAGGAAGCCAACCAGAGUACGU | 1276 | IL4:765L21 antisense siNA (747C) stab10 | | GUACUCUGGUUGGCUUCCUTsT | 1486 |
| 487 | CAGCCUCACAGAGCAGAAGACUC | 1269 | IL4:507L21 antisense siNA (489C) stab19 | | GucuucuGcucuGuGAGGcTT B | 1487 |
| 489 | GCCUCACAGAGCAGAAGACUCUG | 1270 | IL4:509L21 antisense siNA (491C) stab19 | | GAGucuucuGcucuGuGAGTT B | 1488 |
| 516 | CCGAGUUGACCGUAACAGACAUC | 1271 | IL4:536L21 antisense siNA (518C) stab19 | | uGucuGuuAcGGucAAcucTT B | 1489 |
| 526 | CGUAACAGACAUCUUUGCUGCCU | 1272 | IL4:546L21 antisense siNA (528C) stab19 | | GcAGcAAAGAuGucuGuuATT B | 1490 |
| 545 | GCCUCCAAGAACACAACUGAGAA | 1273 | IL4:565L21 antisense siNA (547C) stab19 | | cucAGuuGuGuucuuGGAGTT B | 1491 |
| 606 | UCUACAGCCACCAUGAGAAGGAC | 1274 | IL4:626L21 antisense siNA (6C8C) stab19 | | ccuucucAuGGuGGcuGuATT B | 1492 |
| 728 | UUGAAUUCCUGUCCUGUGAAGGA | 1275 | IL4:748L21 antisense siNA (730C) stab19 | | cuucAcAGGAcAGGAAuucTT B | 1493 |
| 745 | GAAGGAAGCCAACCAGAGUACGU | 1276 | IL4:765L21 antisense siNA (747C) stab19 | | GuAcucuGGuuGGcuuccuTT B | 1494 |
| 487 | CAGCCUCACAGAGCAGAAGACUC | 1269 | IL4:507L21 antisense siNA (489C) stab22 | | GUCUUCUGCUCUGUGAGGCTT B | 1495 |
| 489 | GCCUCACAGAGCAGAAGACUCUG | 1270 | IL4:509L21 antisense siNA (491C) stab22 | | GAGUCUUCUGCUCUGUGAGTT B | 1496 |
| 516 | CCGAGUUGACCGUAACAGACAUC | 1271 | IL4:536L21 antisense siNA (518C) stab22 | | UGUCUGUUACGGUCAACUCTT B | 1497 |
| 526 | CGUAACAGACAUCUUUGCUGCCU | 1272 | IL4:546L21 antisense siNA (528C) stab22 | | GCAGCAAAGAUGUCUGUUATT B | 1498 |
| 545 | GCCUCCAAGAACACAACUGAGAA | 1273 | IL4:565L21 antisense siNA (547C) stab22 | | CUCAGUUGUGUUCUUGGAGTT B | 1499 |
| 606 | UCUACAGCCACCAUGAGAAGGAC | 1274 | IL4:626L21 antisense siNA (608C) stab22 | | CCUUCUCAUGGUGGCUGUATT B | 1500 |
| 728 | UUGAAUUCCUGUCCUGUGAAGGA | 1275 | IL4:748L21 antisense siNA (730C) stab22 | | CUUCACAGGACAGGAAUUCTT B | 1501 |
| 745 | GAAGGAAGCCAACCAGAGUACGU | 1276 | IL4:765L21 antisense siNA (747C) stab22 | | GUACUCUGGUUGGCUUCCUTT B | 1502 |
| | IL4R | | | | | |
| 469 | CUAUACACUGGACCUGUGGGCUG | 1277 | IL4R:471U21 sense siNA | | AUACACUGGACCUGUGGGCTT | 1503 |
| 551 | CCAGGAAACCUGACAGUUCACAC | 1278 | IL4R:553U21 sense siNA | | AGGAAACCUGACAGUUCACTT | 1504 |
| 1119 | AGCACAACAUGAAAAGGGAUGAA | 1279 | IL4R:1121U21 sense siNA | | CACAACAUGAAAGGGAUGTT | 1505 |
| 1120 | GCACAACAUGAAAAGGGAUGAAG | 1280 | IL4R:1122U21 sense siNA | | ACAACAUGAAAAGGGAUGATT | 1506 |
| 1132 | AAGGGAUGAAGAUCCUCACAAGG | 1281 | IL4R:1134U21 sense siNA | | GGGAUGAAGAUCCUCACAATT | 1507 |
| 3130 | UUGGGAAAUCGAUGAGAAAUUGA | 1282 | IL4R:3132U21 sense siNA | | GGGAAAUCGAUGAGAAAUUTT | 1508 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 3131 | UGGGAAAUCGAUGAGAAAUUGAA | 1283 | | IL4R:3133U21 sense siNA | GGAAAUCGAUGAGAAAUUGTT | 1509 |
| 3169 | UCAUUGCCUAGAGGUGCUCAUUC | 1284 | | IL4R:3171U21 sense siNA | AUUGCCUAGAGGUGCUCAUTT | 1510 |
| 469 | CUAUACACUGGACCUGUGGGCUG | 1277 | | IL4R:489L21 antisense siNA (471C) | GCCCACAGGUCCAGUGUAUTT | 1511 |
| 551 | CCAGGAAACCUGACAGUUCACAC | 1278 | | IL4R:571L21 antisense siNA (553C) | GUGAACUGUCAGGUUUCCUTT | 1512 |
| 1119 | AGCACAACAUGAAAAGGGAUGAA | 1279 | | IL4R:1139L21 antisense siNA (1121C) | CAUCCCUUUUCAUGUUGUGTT | 1513 |
| 1120 | GCACAACAUGAAAAGGGAUGAAG | 1280 | | IL4R:1140L21 antisense siNA (1122C) | UCAUCCCUUUUCAUGUUGUTT | 1514 |
| 1132 | AAGGGAUGAAGAUCCUCACAAGG | 1281 | | IL4R:1152L21 antisense siNA (1134C) | UUGUGAGGAUCUUCAUCCCTT | 1515 |
| 3130 | UUGGGAAAUCGAUGAGAAAUUGA | 1282 | | IL4R:3150L21 antisense siNA (3132C) | AAUUUCUCAUCGAUUUCCCTT | 1516 |
| 3131 | UGGGAAAUCGAUGAGAAAUUGAA | 1283 | | IL4R:3151L21 antisense siNA (3133C) | CAAUUUCUCAUCGAUUUCCTT | 1517 |
| 3169 | UCAUUGCCUAGAGGUGCUCAUUC | 1284 | | IL4R:3189L21 antisense siNA (3171C) | AUGAGCACCUCUAGGCAAUTT | 1518 |
| 469 | CUAUACACUGGACCUGUGGGCUG | 1277 | | IL4R:471U21 sense siNA stab04 | B AuAcAcuGGAccuGuGGGcTT B | 1519 |
| 551 | CCAGGAAACCUGACAGUUCACAC | 1278 | | IL4R:553U21 sense siNA stab04 | B AGGAAAccuGAcAGuucAcTT B | 1520 |
| 1119 | AGCACAACAUGAAAAGGGAUGAA | 1279 | | IL4R:1121U21 sense siNA stab04 | B cAcAAcAuGAAAAGGGAuGTT B | 1521 |
| 1120 | GCACAACAUGAAAAGGGAUGAAG | 1280 | | IL4R:1122U21 sense siNA stab04 | B AcAAcAuGAAAAGGGAuGATT B | 1522 |
| 1132 | AAGGGAUGAAGAUCCUCACAAGG | 1281 | | IL4R:1134U21 sense siNA stab04 | B GGGAuGAAGAuccucAcAATT B | 1523 |
| 3130 | UUGGGAAAUCGAUGAGAAAUUGA | 1282 | | IL4R:3132U21 sense siNA stab04 | B GGGAAAucGAuGAGAAAuuTT B | 1524 |
| 3131 | UGGGAAAUCGAUGAGAAAUUGAA | 1283 | | IL4R:3133U21 sense siNA stab04 | B GGAAAucGAuGAGAAAuuGTT B | 1525 |
| 3169 | UCAUUGCCUAGAGGUGCUCAUUC | 1284 | | IL4R:3171U21 sense siNA stab04 | B AuuGccuAGAGGuGcucAuTT B | 1526 |
| 469 | CUAUACACUGGACCUGUGGGCUG | 1277 | | IL4R:489L21 antisense siNA (471C) stab05 | GcccAcAGGuccAGuGuAuTsT | 1527 |
| 551 | CCAGGAAACCUGACAGUUCACAC | 1278 | | IL4R:571L21 antisense siNA (553C) stab05 | GuGAAcuGucAGGuuuccuTsT | 1528 |
| 1119 | AGCACAACAUGAAAAGGGAUGAA | 1279 | | IL4R:1139L21 antisense siNA (1121C) stab05 | cAucccuuuucAuGuuGuGTsT | 1529 |
| 1120 | GCACAACAUGAAAAGGGAUGAAG | 1280 | | IL4R:1140L21 antisense siNA (1122C) stab05 | ucAucccuuuucAuGuuGuTsT | 1530 |
| 1132 | AAGGGAUGAAGAUCCUCACAAGG | 1281 | | IL4R:1152L21 antisense siNA (1134C) stab05 | uuGuGAGGAucuucAucccTsT | 1531 |
| 3130 | UUGGGAAAUCGAUGAGAAAUUGA | 1282 | | IL4R:3150L21 antisense siNA (3132C) stab05 | AAuuucucAucGAuuucccTsT | 1532 |
| 3131 | UGGGAAAUCGAUGAGAAAUUGAA | 1283 | | IL4R:3151L21 antisense siNA (3133C) stab05 | cAAuuucucAucGAuuuccTsT | 1533 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 3169 | UCAUUGCCUAGAGGUGCUCAUUC | 1284 | | IL4R:3189L21 antisense siNA (3171C) stab05 | AuGAGcAccucuAGGcAAuTsT | 1534 |
| 469 | CUAUACACUGGACCUGUGGGCUG | 1277 | | IL4R:471U21 sense siNA stab07 | B AuAcAcuGGAccuGuGGGcTT B | 1535 |
| 551 | CCAGGAAACCUGACAGUUCACAC | 1278 | | IL4R:553U21 sense siNA stab07 | B AGGAAccuGAcAGuucAcTT B | 1536 |
| 1119 | AGCACAACAUGAAAAGGGAUGAA | 1279 | | IL4R:1121U21 sense siNA stab07 | B cAcAAcAuGAAAAGGGAuGTT B | 1537 |
| 1120 | GCACAACAUGAAAAGGGAUGAAG | 1280 | | IL4R:1122U21 sense siNA stab07 | B AcAAcAuGAAAAGGGAuGATT B | 1538 |
| 1132 | AAGGGAUGAAGAUCCUCACAAGG | 1281 | | IL4R:1134U21 sense siNA stab07 | B GGGAuGAAGAuccucAcAATT B | 1539 |
| 3130 | UUGGGAAAUCGAUGAGAAAUUGA | 1282 | | IL4R:3132U21 sense siNA stab07 | B GGGAAAucGAuGAGAAAuuTT B | 1540 |
| 3131 | UGGGAAAUCGAUGAGAAAUUGAA | 1283 | | IL4R:3133U21 sense siNA stab07 | B GGAAAucGAuGAGAAAuuGTT B | 1541 |
| 3169 | UCAUUGCCUAGAGGUGCUCAUUC | 1284 | | IL4R:3171U21 sense siNA stab07 | B AuuGccuAGAGGuGcucAuTT B | 1542 |
| 469 | CUAUACACUGGACCUGUGGGCUG | 1277 | | IL4R:489L21 antisense siNA (471C) stab11 | GcccAcAGGuccAGuGuAuTsT | 1543 |
| 551 | CCAGGAAACCUGACAGUUCACAC | 1278 | | IL4R:571L21 antisense siNA (553C) stab11 | GuGAAcuGucAGGuuuccuTsT | 1544 |
| 1119 | AGCACAACAUGAAAAGGGAUGAA | 1279 | | IL4R:1139L21 antisense siNA (1121C) stab11 | cAucccuuuucAuGuuGuGTsT | 1545 |
| 1120 | GCACAACAUGAAAAGGGAUGAAG | 1280 | | IL4R:1140L21 antisense siNA (1122C) stab11 | ucAucccuuuucAuGuuGuGTsT | 1546 |
| 1132 | AAGGGAUGAAGAUCCUCACAAGG | 1281 | | IL4R:1152L21 antisense siNA (1134C) stab11 | uuGuGAGGAucuucAucccTsT | 1547 |
| 3130 | UUGGGAAAUCGAUGAGAAAUUGA | 1282 | | IL4R:3150L21 antisense siNA (3132C) stab11 | AAuuucucAucGAuuucccTsT | 1548 |
| 3131 | UGGGAAAUCGAUGAGAAAUUGAA | 1283 | | IL4R:315lL21 antisense siNA (3133C) stab11 | cAAuuucucAucGAuuuccTsT | 1549 |
| 3169 | UCAUUGCCUAGAGGUGCUCAUUC | 1284 | | IL4R:3189L21 antisense siNA (3171C) stab11 | AuGAGcAccucuAGGcAAuTsT | 1550 |
| 469 | CUAUACACUGGACCUGUGGGCUG | 1277 | | IL4R:471U21 sense siNA stab18 | B AuAcAcuGGAccuGuGGGcTTB | 1551 |
| 551 | CCAGGAAACCUGACAGUUCACAC | 1278 | | IL4R:553U21 sense siNA stab18 | B AGGAAccuGAcAGuucAcTT B | 1552 |
| 1119 | AGCACAACAUGAAAAGGGAUGAA | 1279 | | IL4R:1121U21 sense siNA stab18 | B cAcAAcAuGAAAAGGGAuGTT B | 1553 |
| 1120 | GCACAACAUGAAAAGGGAUGAAG | 1280 | | IL4R:1122U21 sense siNA stab18 | B AcAAcAuGAAAAGGGAuGATT B | 1554 |
| 1132 | AAGGGAUGAAGAUCCUCACAAGG | 1281 | | IL4R:1134U21 sense siNA stab18 | B GGGAuGAAGAuccucAcAATT B | 1555 |
| 3130 | UUGGGAAAUCGAUGAGAAAUUGA | 1282 | | IL4R:3132U21 sense siNA stab18 | B GGGAAAucGAuGAGAAAuuTT B | 1556 |
| 3131 | UGGGAAAUCGAUGAGAAAUUGAA | 1283 | | IL4R:3133U21 sense siNA stab18 | B GGAAAucGAuGAGAAAuuGTT B | 1557 |
| 3169 | UCAUUGCCUAGAGGUGCUCAUUC | 1284 | | IL4R:3171U21 sense siNA stab18 | B AuuGccuAGAGGuGcucAuTT B | 1558 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 469 | CUAUACACUGGACCUGUGGGCUG | 1277 | | IL4R:489L21 antisense siNA (471C) stab08 | GcccAcAGGuccAGuGuAuTsT | 1559 |
| 551 | CCAGGAAACCUGACAGUUCACAC | 1278 | | IL4R:571L21 antisense siNA (553C) stab08 | GuGAAcuGucAGGuuuccuTsT | 1560 |
| 1119 | AGCACAACAUGAAAAGGGAUGAA | 1279 | | IL4R:1139L21 antisense siNA (1121C) stab08 | cAucccuuuucAuGuuGuGTsT | 1561 |
| 1120 | GCACAACAUGAAAAGGGAUGAAG | 1280 | | IL4R:1140L21 antisense siNA (1122C) stab08 | ucAucccuuuucAuGuuGuTsT | 1562 |
| 1132 | AAGGGAUGAAGAUCCUCACAAGG | 1281 | | IL4R:1152L21 antisense siNA (1134C) stab08 | uuGuGAGGAucuucAucccTsT | 1563 |
| 3130 | UUGGGAAAUCGAUGAGAAAUUGA | 1282 | | IL4R:3150L21 antisense siNA (3132C) stab08 | AAuuucucAucGAuuucccTsT | 1564 |
| 3131 | UGGGAAAUCGAUGAGAAAUUGAA | 1283 | | IL4R:315IL21 antisense siNA (3133C) stab08 | cAAuuucucAucGAuuuccTsT | 1565 |
| 3169 | UCAUUGCCUAGAGGUGCUCAUUC | 1284 | | IL4R:3189L21 antisense siNA (3171C) stab08 | AuGAGcAccucuAGGcAAuTsT | 1566 |
| 469 | CUAUACACUGGACCUGUGGGCUG | 1277 | 36729 | IL4R:471U21 sense siNA stab09 | B AUACACUGGACCUGUGGGCUT B | 1567 |
| 551 | CCAGGAAACCUGACAGUUCACAC | 1278 | 36730 | IL4R:553U21 sense siNA stab09 | B AGGAAACCUGACAGUUCACUT B | 1568 |
| 1119 | AGCACAACAUGAAAAGGGAUGAA | 1279 | 36731 | IL4R:1121U21 sense siNA stab09 | B CACAACAUGAAAAGGGAUGUT B | 1569 |
| 1120 | GCACAACAUGAAAAGGGAUGAAG | 1280 | 36732 | IL4R:1122U21 sense siNA stab09 | B ACAACAUGAAAAGGGAUGAUT B | 1570 |
| 1132 | AAGGGAUGAAGAUCCUCACAAGG | 1281 | 36733 | IL4R:1134U21 sense siNA stab09 | B GGGAUGAAGAUCCUCACAAUT B | 1571 |
| 3130 | UUGGGAAAUCGAUGAGAAAUUGA | 1282 | 36734 | IL4R:3132U21 sense siNA stab09 | B GGGAAAUCGAUGAGAAAUUUT B | 1572 |
| 3131 | UGGGAAAUCGAUGAGAAAUUGAA | 1283 | 36735 | IL4R:3133U21 sense siNA stab09 | B GGAAAUCGAUGAGAAAUUGUT B | 1573 |
| 3169 | UCAUUGCCUAGAGGUGCUCAUUC | 1284 | 36736 | IL4R:3171U21 sense siNA stab09 | B AUUGCCUAGAGGUGCUCAUTT B | 1574 |
| 469 | CUAUACACUGGACCUGUGGGCUG | 1277 | | IL4R:489L21 antisense siNA (471C) stab10 | GCCCACAGGUCCAGUGUAUTsT | 1575 |
| 551 | CCAGGAAACCUGACAGUUCACAC | 1278 | | IL4R:571L21 antisense siNA (553C) stab10 | GUGAACUGUCAGGUUUCCUTsT | 1576 |
| 1119 | AGCACAACAUGAAAAGGGAUGAA | 1279 | | IL4R:1139L21 antisense siNA (1121C) stab10 | CAUCCCUUUUCAUGUUGUGTsT | 1577 |
| 1120 | GCACAACAUGAAAAGGGAUGAAG | 1280 | | IL4R:1140L21 antisense siNA (1122C) stab10 | UCAUCCCUUUUCAUGUUGUTsT | 1578 |
| 1132 | AAGGGAUGAAGAUCCUCACAAGG | 1281 | | IL4R:1152L21 antisense siNA (1134C) stab10 | UUGUGAGGAUCUUCAUCCCTsT | 1579 |
| 3130 | UUGGGAAAUCGAUGAGAAAUUGA | 1282 | | IL4R:3150L21 antisense siNA (3132C) stab10 | AAUUUCUCAUCGAUUUCCCTsT | 1580 |
| 3131 | UGGGAAAUCGAUGAGAAAUUGAA | 1283 | | IL4R:315IL21 antisense siNA (3133C) stab10 | CAAUUUCUCAUCGAUUUCCTsT | 1581 |
| 3169 | UCAUUGCCUAGAGGUGCUCAUUC | 1284 | | IL4R:3189L21 antisense siNA (3171C) stab10 | AUGAGCACCUCUAGGCAAUTsT | 1582 |
| 469 | CUAUACACUGGACCUGUGGGCUG | 1277 | 36737 | IL4R:489L21 antisense siNA (471C) stab19 | GcccAcAGGuccAGuGuAuTT B | 1583 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 551 | CCAGGAAACCUGACAGUUCACAC | 1278 | 36738 | IL4R:571L21 antisense siNA (553C) stab19 | GuGAAcuGucAGGuuuccuTT B | 1584 |
| 1119 | AGCACAACAUGAAAAGGGAUGAA | 1279 | 36739 | IL4R:1139L21 antisense siNA (1121C) stab19 | cAucccuuuucAuGuuGuGTT B | 1585 |
| 1120 | GCACAACAUGAAAAGGGAUGAAG | 1280 | 36740 | IL4R:1140L21 antisense siNA (1122C) stab19 | ucAucccuuuucAuGuuGuTT B | 1586 |
| 1132 | AAGGGAUGAAGAUCCUCACAAGG | 1281 | 36741 | IL4R:1152L21 antisense siNA (1134C) stab19 | uuGuGAGGAucuucAucccTT B | 1587 |
| 3130 | UUGGGAAAUCGAUGAGAAAUUGA | 1282 | 36742 | IL4R:3150L21 antisense siNA (3132C) stab19 | AAuuucucAucGAuuucccTT B | 1588 |
| 3131 | UGGGAAAUCGAUGAGAAAUUGAA | 1283 | 36743 | IL4R:315lL21 antisense siNA (3133C) stab19 | cAAuuucucAucGAuuuccTT B | 1589 |
| 3169 | UCAUUGCCUAGAGGUGCUCAUUC | 1284 | 36744 | IL4R:3189L21 antisense siNA (3171C) stab19 | AuGAGcAccucuAGGcAAuTT B | 1590 |
| 469 | CUAUACACUGGACCUGUGGGCUG | 1277 | 36745 | IL4R:489L21 antisense siNA (471C) stab22 | GCCCACAGGUCCAGUGUAUTT B | 1591 |
| 551 | CCAGGAAACCUGACAGUUCACAC | 1278 | 36746 | IL4R:571L21 antisense siNA (553C) stab22 | GUGAACUGUCAGGUUUCCUTT B | 1592 |
| 1119 | AGCACAACAUGAAAAGGGAUGAA | 1279 | 36747 | IL4R:1139L21 antisense siNA (1121C) stab22 | CAUCCCUUUUCAUGUUGUGTT B | 1593 |
| 1120 | GCACAACAUGAAAAGGGAUGAAG | 1280 | 36748 | IL4R:1140L21 antisense siNA (1122C) stab22 | UCAUCCCUUUUCAUGUUGUTT B | 1594 |
| 1132 | AAGGGAUGAAGAUCCUCACAAGG | 1281 | 36749 | IL4R:1152L21 antisense siNA (1134C) stab22 | UUGUGAGGAUCUUCAUCCCTT B | 1595 |
| 3130 | UUGGGAAAUCGAUGAGAAAUUGA | 1282 | 36750 | IL4R:3150L21 antisense siNA (3132C) stab22 | AAUUUCUCAUCGAUUUCCCTT B | 1596 |
| 3131 | UGGGAAAUCGAUGAGAAAUUGAA | 1283 | 36751 | IL4R:315lL21 antisense siNA (3133C) stab22 | CAAUUUCUCAUCGAUUUCCTT B | 1597 |
| 3169 | UCAUUGCCUAGAGGUGCUCAUUC | 1284 | 36752 | IL4R:3189L21 antisense siNA (3171C) stab22 | AUGAGCACCUCUAGGCAAUTT B | 1598 |
| | | | | IL13 | | |
| 391 | CCCAGUUUGUAAAGGACCUGCUC | 1285 | | IL13:393U21 sense siNA | CAGUUUGUAAAGGACCUGCTT | 1599 |
| 797 | CACUUCACACACAGGCAACUGAG | 1286 | | IL13:799U21 sense siNA | CUUCACACACAGGCAACUGTT | 1600 |
| 832 | UCAGGCACACUUCUUCUUGGUCU | 1287 | | IL13:834U21 sense siNA | AGGCACACUUCUUCUUGGUTT | 1601 |
| 911 | AAGACUGUGGCUGCUAGCACUUG | 1288 | | IL13:913U21 sense siNA | GACUGUGGCUGCUAGCACUTT | 1602 |
| 963 | AGCACUAAAGCAGUGGACACCAG | 1289 | | IL13:965U21 sense siNA | CACUAAAGCAGUGGACACCTT | 1603 |
| 965 | CACUAAAGCAGUGGACACCAGGA | 1290 | | IL13:967U21 sense siNA | CUAAAGCAGUGGACACCAGTT | 1604 |
| 968 | UAAAGCAGUGGACACCAGGAGUC | 1291 | | IL13:970U21 sense siNA | AAGCAGUGGACACCAGGAGTT | 1605 |
| 1191 | AGAAGGGUACCUUGAACACUGGG | 1292 | | IL13:1193U21 sense siNA | AAGGGUACCUUGAACACUGTT | 1606 |
| 391 | CCCAGUUUGUAAAGGACCUGCUC | 1285 | | IL13:411L21 antisense siNA (393C) | GCAGGUCCUUUACAAACUGTT | 1607 |
| 797 | CACUUCACACACAGGCAACUGAG | 1286 | | IL13:817L21 antisense siNA (799C) | CAGUUGCCUGUGUGUGAAGTT | 1608 |
| 832 | UCAGGCACACUUCUUCUUGGUCU | 1287 | | IL13:852L21 antisense siNA (834C) | ACCAAGAAGAAGUGUGCCUTT | 1609 |
| 911 | AAGACUGUGGCUGCUAGCACUUG | 1288 | | IL13:931L21 antisense siNA (913C) | AGUGCUAGCAGCCACAGUCTT | 1610 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 963 | AGCACUAAAGCAGUGGACACCAG | 1289 | | IL13:983L21 antisense siNA (965C) | GGUGUCCACUGCUUUAGUGTT | 1611 |
| 965 | CACUAAAGCAGUGGACACCAGGA | 1290 | | IL13:985L21 antisense siNA (967C) | CUGGUGUCCACUGCUUUAGTT | 1612 |
| 968 | UAAAGCAGUGGACACCAGGAGUC | 1291 | | IL13:988L21 antisense siNA (970C) | CUCCUGGUGUCCACUGCUUTT | 1613 |
| 1191 | AGAAGGGUACCUUGAACACUGGG | 1292 | | IL13:121IL21 antisense siNA (1193C) | CAGUGUUCAAGGUACCCUUTT | 1614 |
| 391 | CCCAGUUUGUAAAGGACCUGCUC | 1285 | | IL13:393U21 sense siNA stab04 | B cAGuuuGuAAAGGAccuGcTT B | 1615 |
| 797 | CACUUCACACACAGGCAACUGAG | 1286 | | IL13:799U21 sense siNA stab04 | B cuucAcAcAcAGGcAAcuGTT B | 1616 |
| 832 | UCAGGCACACUUCUUCUUGGUCU | 1287 | | IL13:834U21 sense siNA stab04 | B AGGcAcAcuucuucuuGGuTT B | 1617 |
| 911 | AAGACUGUGGCUGCUAGCACUUG | 1288 | | IL13:913U21 sense siNA stab04 | B GAcuGuGGcuGcuAGcAcuTT B | 1618 |
| 963 | AGCACUAAAGCAGUGGACACCAG | 1289 | | IL13:965U21 sense siNA stab04 | B cAcuAAAGcAGuGGAcAccTT B | 1619 |
| 965 | CACUAAAGCAGUGGACACCAGGA | 1290 | | IL13:967U21 sense siNA stab04 | B cuAAAGcAGuGGAcAccAGTT B | 1620 |
| 968 | UAAAGCAGUGGACACCAGGAGUC | 1291 | | IL13:970U21 sense siNA stab04 | B AAGcAGuGGAcAccAGGAGTT B | 1621 |
| 1191 | AGAAGGGUACCUUGAACACUGGG | 1292 | | IL13:1193U21 sense siNA stab04 | B AAGGGuAccuuGAAcAcuGTT B | 1622 |
| 391 | CCCAGUUUGUAAAGGACCUGCUC | 1285 | | IL13:411L21 antisense siNA (393C) stab05 | GcAGGuccuuuAcAAAcuGTsT | 1623 |
| 797 | CACUUCACACACAGGCAACUGAG | 1286 | | IL13:817L21 antisense siNA (799C) stab05 | cAGuuGccuGuGuGuGAAGTsT | 1624 |
| 832 | UCAGGCACACUUCUUCUUGGUCU | 1287 | | IL13:852L21 antisense siNA (834C) stab05 | AccAAGAAGAAGuGuGccuTsT | 1625 |
| 911 | AAGACUGUGGCUGCUAGCACUUG | 1288 | | IL13:931L21 antisense siNA (913C) stab05 | AGuGcuAGcAGccAcAGucTsT | 1626 |
| 963 | AGCACUAAAGCAGUGGACACCAG | 1289 | | IL13:983L21 antisense siNA (965C) stab05 | GGuGuccAcuGcuuuAGuGTsT | 1627 |
| 965 | CACUAAAGCAGUGGACACCAGGA | 1290 | | IL13:985L21 antisense siNA (967C) stab05 | cuGGuGuccAcuGcuuuAGTsT | 1628 |
| 968 | UAAAGCAGUGGACACCAGGAGUC | 1291 | | IL13:988L21 antisense siNA (970C) stab05 | cuccuGGuGuccAcuGcuuTsT | 1629 |
| 1191 | AGAAGGGUACCUUGAACACUGGG | 1292 | | IL13:121IL21 antisense siNA (1193C) stab05 | cAGuGuucAAGGuAcccuuTsT | 1630 |
| 864 | UAUUGUGUGUUAUUUAAAUGAGU | 1293 | 33355 | IL13:864U21 sense siNA stab07 | B uuGuGuGuuAuuuAAAuGATT B | 1631 |
| 865 | AUUGUGUGUUAUUUAAAUGAGUG | 1294 | 33356 | IL13:865U21 sense siNA stab07 | B uGuGuGuuAuuuAAAuGAGTT B | 1632 |
| 866 | UUGUGUGUUAUUUAAAUGAGUGU | 1295 | 33357 | IL13:866U21 sense siNA stab07 | B GuGuGuuAuuuAAAuGAGuTT B | 1633 |
| 863 | UUAUUGUGUGUUAUUUAAAUGAG | 1296 | 33358 | IL13:863U21 sense siNA stab07 | B AuuGuGuGuuAuuuAAAuGTT B | 1634 |
| 200 | UGCAAUGGCAGCAUGGUAUGGAG | 1297 | 33359 | IL13:200U21 sense siNA stab07 | B cAAuGGcAGcAuGGuAuGGTT B | 1635 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 201 | GCAAUGGCAGCAUGGUAUGGAGC | 1298 | 33360 | IL13:201U21 sense siNA stab07 | B AAuGGcAGcAuGGuAuGGATT B | 1636 |
| 202 | CAAUGGCAGCAUGGUAUGGAGCA | 1299 | 33361 | IL13:202U21 sense siNA stab07 | B AuGGcAGcAuGGuAuGGAGTT B | 1637 |
| 860 | UUAUUAUUGUGUGUUAUUUAAAU | 1300 | 33362 | IL13:860U21 sense siNA stab07 | B AuuAuuGuGuGuuAuuuAATT B | 1638 |
| 861 | UAUUAUUGUGUGUUAUUUAAAUG | 1301 | 33363 | IL13:861U21 sense siNA stab07 | B uuAuuGuGuGuuAuuuAAATT B | 1639 |
| 862 | AUUAUUGUGUGUUAUUUAAAUGA | 1302 | 33364 | IL13:862U21 sense siNA stab07 | B uAuuGuGuGuuAuuuAAAuTT B | 1640 |
| 391 | CCCAGUUUGUAAAGGACCUGCUC | 1285 | | IL13:393U21 sense siNA stab07 | B cAGuuuGuAAAGGAccuGcTT B | 1641 |
| 797 | CACUUCACACACAGGCAACUGAG | 1286 | | IL13:799U21 sense siNA stab07 | B cuucAcAcAcAGGcAAcuGTT B | 1642 |
| 832 | UCAGGCACACUUCUUCUUGGUCU | 1287 | | IL13:834U21 sense siNA stab07 | B AGGcAcAcuucuucuuGGuTT B | 1643 |
| 911 | AAGACUGUGGCUGCUAGCACUUG | 1288 | | IL13:913U21 sense siNA stab07 | B GAcuGuGGcuGcuAGcAcuTT B | 1644 |
| 963 | AGCACUAAAGCAGUGGACACCAG | 1289 | | IL13:965U21 sense siNA stab07 | B cAcuAAAGcAGuGGAcAccTT B | 1645 |
| 965 | CACUAAAGCAGUGGACACCAGGA | 1290 | | IL13:967U21 sense siNA stab07 | B cuAAAGcAGuGGAcAccAGTT B | 1646 |
| 968 | UAAAGCAGUGGACACCAGGAGUC | 1291 | | IL13:970U21 sense siNA stab07 | B AAGcAGuGGAcAccAGGAGTT B | 1647 |
| 1191 | AGAAGGGUACCUUGAACACUGGG | 1292 | | IL13:1193U21 sense siNA stab07 | B AAGGGuAccuuGAAcAcuGTT B | 1648 |
| 391 | CCCAGUUUGUAAAGGACCUGCUC | 1285 | | IL13:411L21 antisense siNA (393C) stab11 | GcAGGuccuuuAcAAAcuGTsT | 1649 |
| 797 | CACUUCACACACAGGCAACUGAG | 1286 | | IL13:817L21 antisense siNA (799C) stab11 | cAGuuGccuGuGuGAAGTsT | 1650 |
| 832 | UCAGGCACACUUCUUCUUGGUCU | 1287 | | IL13:852L21 antisense siNA (834C) stab11 | AccAAGAAGAAGuGuGccuTsT | 1651 |
| 911 | AAGACUGUGGCUGCUAGCACUUG | 1288 | | IL13:931L21 antisense siNA (913C) stab11 | AGuGcuAGcAGccAcAGucTsT | 1652 |
| 963 | AGCACUAAAGCAGUGGACACCAG | 1289 | | IL13:983L21 antisense siNA (965C) stab11 | GGuGuccAcuGcuuuAGuGTsT | 1653 |
| 965 | CACUAAAGCAGUGGACACCAGGA | 1290 | | IL13:985L21 antisense siNA (967C) stab11 | cuGGuGuccAcuGcuuuAGTsT | 1654 |
| 968 | UAAAGCAGUGGACACCAGGAGUC | 1291 | | IL13:988L21 antisense siNA (970C) stab11 | cuccuGGuGuccAcuGcuuTsT | 1655 |
| 1191 | AGAAGGGUACCUUGAACACUGGG | 1292 | | IL13:1211L21 antisense siNA (1193C) stab11 | cAGuGuucAAGGuAcccuuTsT | 1656 |
| 391 | CCCAGUUUGUAAAGGACCUGCUC | 1285 | | IL13:393U21 sense siNA stab18 | B cAGuuuGuAAAGGAccuGcTT B | 1657 |
| 797 | CACUUCACACACAGGCAACUGAG | 1286 | | IL13:799U21 sense siNA stab18 | B cuucAcAcAcAGGcAAcuGTT B | 1658 |
| 832 | UCAGGCACACUUCUUCUUGGUCU | 1287 | | IL13:834U21 sense siNA stab18 | B AGGcAcAcuucuucuuGGuTT B | 1659 |
| 911 | AAGACUGUGGCUGCUAGCACUUG | 1288 | | IL13:913U21 sense siNA stab18 | B GAcuGuGGcuGcuAGcAcuTT B | 1660 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 963 | AGCACUAAAGCAGUGGACACCAG | 1289 | | IL13:965U21 sense siNA stab18 | B cAcuAAAGcAGuGGAcAccTT B | 1661 |
| 965 | CACUAAAGCAGUGGACACCAGGA | 1290 | | IL13:967U21 sense siNA stab18 | B cuAAAGcAGuGGAcAccAGTT B | 1662 |
| 968 | UAAAGCAGUGGACACCAGGAGUC | 1291 | | IL13:970U21 sense siNA stab18 | B AAGcAGuGGAcAccAGGAGTT B | 1663 |
| 1191 | AGAAGGGUACCUUGAACACUGGG | 1292 | | IL13:1193U21 sense siNA stab18 | B AAGGGuAccuuGAAcAcuGTT B | 1664 |
| 864 | UAUUGUGUGUUAUUUAAAUGAGU | 1293 | 33375 | IL13:882L21 antisense siNA (864C) stab08 | ucAuuuAAAuAAcAcAcAATsT | 1665 |
| 865 | AUUGUGUGUUAUUUAAAUGAGUG | 1294 | 33376 | IL13:883L21 antisense siNA (865C) stab08 | cucAuuuAAAuAAcAcAcATsT | 1666 |
| 866 | UUGUGUGUUAUUUAAAUGAGUGU | 1295 | 33377 | IL13:884L21 antisense siNA (866C) stab08 | AcucAuuuAAAuAAcAcAcTsT | 1667 |
| 863 | UUAUUGUGUGUUAUUUAAAUGAG | 1296 | 33378 | IL13:88lL21 antisense siNA (863C) stab08 | cAuuuAAAuAAcAcAcAAuTsT | 1668 |
| 200 | UGCAAUGGCAGCAUGGUAUGGAG | 1297 | 33379 | IL13:218L21 antisense siNA (200C) stab08 | ccAuAccAuGcuGccAuuGTsT | 1669 |
| 201 | GCAAUGGCAGCAUGGUAUGGAGC | 1298 | 33380 | IL13:219L21 antisense siNA (201C) stab08 | uccAuAccAuGcuGccAuuTsT | 1670 |
| 202 | CAAUGGCAGCAUGGUAUGGAGCA | 1299 | 33381 | IL13:220L21 antisense siNA (202C) stab08 | cuccAuAccAuGcuGccAuTsT | 1671 |
| 860 | UUAUUAUUGUGUGUUAUUUAAAU | 1300 | 33382 | IL13:878L21 antisense siNA (860C) stab08 | uuAAAuAAcAcAcAAuAAuTsT | 1672 |
| 861 | UAUUAUUGUGUGUUAUUUAAAUG | 1301 | 33383 | IL13:879L21 antisense siNA (861C) stab08 | uuuAAAuAAcAcAcAAuAATsT | 1673 |
| 862 | AUUAUUGUGUGUUAUUUAAAUGA | 1302 | 33384 | IL13:880L21 antisense siNA (862C) stab08 | AuuuAAAuAAcAcAcAAuATsT | 1674 |
| 391 | CCCAGUUUGUAAAGGACCUGCUC | 1285 | | IL13:411L21 antisense siNA (393C) stab08 | GcAGGuccuuuAcAAAcuGTsT | 1675 |
| 797 | CACUUCACACACAGGCAACUGAG | 1286 | | IL13:817L21 antisense siNA (799C) stab08 | cAGuuGccuGuGuGuGAAGTsT | 1676 |
| 832 | UCAGGCACACUUCUUCUUGGUCU | 1287 | | IL13:852L21 antisense siNA (834C) stab08 | AccAAGAAGAAGuGuGccuTsT | 1677 |
| 911 | AAGACUGUGGCUGCUAGCACUUG | 1288 | | IL13:931L21 antisense siNA (913C) stab08 | AGuGcuAGcAGccAcAGucTsT | 1678 |
| 963 | AGCACUAAAGCAGUGGACACCAG | 1289 | | IL13:983L21 antisense siNA (965C) stab08 | GGuGuccAcuGcuuuAGuGTsT | 1679 |
| 965 | CACUAAAGCAGUGGACACCAGGA | 1290 | | IL13:985L21 antisense siNA (967C) stab08 | cuGGuGuccAcuGcuuuAGTsT | 1680 |
| 968 | UAAAGCAGUGGACACCAGGAGUC | 1291 | | IL13:988L21 antisense siNA (970C) stab08 | cuccuGGuGuccAcuGcuuTsT | 1681 |
| 1191 | AGAAGGGUACCUUGAACACUGGG | 1292 | | IL13:121lL21 antisense siNA (1193C) stab08 | cAGuGuucAAGGuAcccuuTsT | 1682 |
| 391 | CCCAGUUUGUAAAGGACCUGCUC | 1285 | 36890 | IL13:393U21 sense siNA stab09 | B CAGUUUGUAAAGGACCUGCTT B | 1683 |
| 797 | CACUUCACACACAGGCAACUGAG | 1286 | 36891 | IL13:799U21 sense siNA stab09 | B CUUCACACACAGGCAACUGTT B | 1684 |
| 832 | UCAGGCACACUUCUUCUUGGUCU | 1287 | 36892 | IL13:834U21 sense siNA stab09 | B AGGCACACUUCUUCUUGGUTT B | 1685 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 911 | AAGACUGUGGCUGCUAGCACUUG | 1288 | 36893 | IL13:913U21 sense siNA stab09 | B GACUGGGCUGCUAGCACUTT B | 1686 |
| 963 | AGCACUAAAGCAGUGGACACCAG | 1289 | 36894 | IL13:965U21 sense siNA stab09 | B CACUAAAGCAGUGGACACCTT B | 1687 |
| 965 | CACUAAAGCAGUGGACACCAGGA | 1290 | 36895 | IL13:967U21 sense siNA stab09 | B CUAAAGCAGUGGACACCAGTT B | 1688 |
| 968 | UAAAGCAGUGGACACCAGGAGUC | 1291 | 36896 | IL13:970U21 sense siNA stab09 | B AAGCAGUGGACACCAGGAGTT B | 1689 |
| 1191 | AGAAGGGUACCUUGAACACUGGG | 1292 | 36897 | IL13:1193U21 sense siNA stab09 | B AAGGGUACCUUGAACACUGTT B | 1690 |
| 391 | CCCAGUUUGUAAAGGACCUGCUC | 1285 | | IL13:411L21 antisense siNA (393C) stab10 | GCAGGUCCUUUACAAACUGTsT | 1691 |
| 797 | CACUUCACACACAGGCAACUGAG | 1286 | | IL13:817L21 antisense siNA (799C) stab10 | CAGUUGCCUGUGUGUGAAGTsT | 1692 |
| 832 | UCAGGCACACUUCUUCUUGGUCU | 1287 | | IL13:852L21 antisense siNA (834C) stab10 | ACCAAGAAGAAGUGUGCCUTsT | 1693 |
| 911 | AAGACUGUGGCUGCUAGCACUUG | 1288 | | IL13:931L21 antisense siNA (913C) stab10 | AGUGCUAGCAGCCACAGUCTsT | 1694 |
| 963 | AGCACUAAAGCAGUGGACACCAG | 1289 | | IL13:983L21 antisense siNA (965C) stab10 | GGUGUCCACUGCUUUAGUGTsT | 1695 |
| 965 | CACUAAAGCAGUGGACACCAGGA | 1290 | | IL13:985L21 antisense siNA (967C) stab10 | CUGGUGUCCACUGCUUUAGTsT | 1696 |
| 968 | UAAAGCAGUGGACACCAGGAGUC | 1291 | | IL13:988L21 antisense siNA (970C) stab10 | CUCCUGGUGUCCACUGCUUTsT | 1697 |
| 1191 | AGAAGGGUACCUUGAACACUGGG | 1292 | | IL13:1211L21 antisense siNA (1193C) stab10 | CCAGUGUUCAAGGUACCCUUTsT | 1698 |
| 391 | CCCAGUUUGUAAAGGACCUGCUC | 1285 | | IL13:411L21 antisense siNA (393C) stab19 | GcAGGuccuuuAcAAAcuGTT B | 1699 |
| 797 | CACUUCACACACAGGCAACUGAG | 1286 | | IL13:817L21 antisense siNA (799C) stab19 | cAGuuGccuGuGuGuGAAGTT B | 1700 |
| 832 | UCAGGCACACUUCUUCUUGGUCU | 1287 | | IL13:852L21 antisense siNA (834C) stab19 | AccAAGAAGAAGuGuGccuTT B | 1701 |
| 911 | AAGACUGUGGCUGCUAGCACUUG | 1288 | | IL13:931L21 antisense siNA (913C) stab19 | AGuGcuAGcAGccAcAGucTT B | 1702 |
| 963 | AGCACUAAAGCAGUGGACACCAG | 1289 | | IL13:983L21 antisense siNA (965C) stab19 | GGuGuccAcuGcuuuAGuGTT B | 1703 |
| 965 | CACUAAAGCAGUGGACACCAGGA | 1290 | | IL13:985L21 antisense siNA (967C) stab19 | cuGGuGuccAcuGcuuuAGTT B | 1704 |
| 968 | UAAAGCAGUGGACACCAGGAGUC | 1291 | | IL13:988L21 antisense siNA (970C) stab19 | cuccuGGuGuccAcuGcuuTT B | 1705 |
| 1191 | AGAAGGGUACCUUGAACACUGGG | 1292 | | IL13:1211L21 antisense siNA (1193C) stab19 | cAGuGuucAAGGuAcccuuTT B | 1706 |
| 391 | CCCAGUUUGUAAAGGACCUGCUC | 1285 | 36898 | IL13:411L21 antisense siNA (393C) stab22 | GCAGGUCCUUUACAAACUGTT B | 1707 |
| 797 | CACUUCACACACAGGCAACUGAG | 1286 | 36899 | IL13:817L21 antisense siNA (799C) stab22 | CAGUUGCCUGUGUGUGAAGTT B | 1708 |
| 832 | UCAGGCACACUUCUUCUUGGUCU | 1287 | 36900 | IL13:852L21 antisense siNA (834C) stab22 | ACCAAGAAGAAGUGUGCCUTT B | 1709 |
| 911 | AAGACUGUGGCUGCUAGCACUUG | 1288 | 36901 | IL13:931L21 antisense siNA (913C) stab22 | AGUGCUAGCAGCCACAGUCTTB | 1710 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 963 | AGCACUAAAGCAGUGGACACCAG | 1289 | 36902 | IL13:983L21 antisense siNA (965C) stab22 | GGUGUCCACUGCUUUAGUGTT B | 1711 |
| 965 | CACUAAAGCAGUGGACACCAGGA | 1290 | 36903 | IL13:985L21 antisense siNA (967C) stab22 | CUGGUGUCCACUGCUUUAGTT B | 1712 |
| 968 | UAAAGCAGUGGACACCAGGAGUC | 1291 | 36904 | IL13:988L21 antisense siNA (970C) stab22 | CUCCUGGUGUCCACUGCUUTT B | 1713 |
| 1191 | AGAAGGGUACCUUGAACACUGGG | 1292 | 36905 | IL13:121IL21 antisense siNA (1193C) stab22 | CAGUGUUCAAGGUACCCUUTT B | 1714 |
| | IL13R | | | | | |
| 408 | AAGGUGAUCCUGAGUCUGCUGUG | 1303 | | IL13RA1:410U21 sense siNA | GGUGAUCCUGAGUCUGCUGTT | 1715 |
| 657 | UGGUCAAGGAUAAUGCAGGAAAA | 1304 | | IL13RA1:659U21 sense siNA | GUCAAGGAUAAUGCAGGAATT | 1716 |
| 871 | CGUCCAAGAGGCUAAAUGUGAGA | 1305 | | IL13RA1:873U21 sense siNA | UCCAAGAGGCUAAAUGUGATT | 1717 |
| 1276 | GGAAACCGACUCUGUAGUGCUGA | 1306 | | IL13RA1:1278U21 sense siNA | AAACCGACUCUGUAGUGCUTT | 1718 |
| 1308 | UGAAGAAAGCCUCUCAGUGAUGG | 1307 | | IL13RA1:1310U21 sense siNA | AAGAAAGCCUCUCAGUGAUTT | 1719 |
| 1424 | ACUGCACCAUUUAAAAACAGGCA | 1308 | | IL13RA1:1426U21 sense siNA | UGCACCAUUUAAAAACAGGTT | 1720 |
| 2186 | CAGCAUUUUCCUCUGCUUUGAAA | 1309 | | IL13RA1:2188U21 sense siNA | GCAUUUUCCUCUGCUUUGATT | 1721 |
| 2270 | CCAAGACCUUUCAAAGCCAUUUU | 1310 | | IL13RA1:2272U21 sense siNA | AAGACCUUUCAAAGCCAUUTT | 1722 |
| 408 | AAGGUGAUCCUGAGUCUGCUGUG | 1303 | | IL13RA1:428L21 antisense siNA (410C) | CAGCAGACUCAGGAUCACCTT | 1723 |
| 657 | UGGUCAAGGAUAAUGCAGGAAAA | 1304 | | IL13RA1:677L21 antisense siNA (659C) | UUCCUGCAUUAUCCUUGACTT | 1724 |
| 871 | CGUCCAAGAGGCUAAAUGUGAGA | 1305 | | IL13RA1:89IL21 antisense siNA (873C) | UCACAUUUAGCCUCUUGGATT | 1725 |
| 1276 | GGAAACCGACUCUGUAGUGCUGA | 1306 | | IL13RA1:1296L21 antisense siNA (1278C) | AGCACUACAGAGUCGGUUUTT | 1726 |
| 1308 | UGAAGAAAGCCUCUCAGUGAUGG | 1307 | | IL13RA1:1328L21 antisense siNA (1310C) | AUCACUGAGAGGCUUUCUUTT | 1727 |
| 1424 | ACUGCACCAUUUAAAAACAGGCA | 1308 | | IL13RA1:1444L21 antisense siNA (1426C) | CCUGUUUUUAAAUGGUGCATT | 1728 |
| 2186 | CAGCAUUUUCCUCUGCUUUGAAA | 1309 | | IL13RA1:2206L21 antisense siNA (2188C) | UCAAAGCAGAGGAAAAUGCTT | 1729 |
| 2270 | CCAAGACCUUUCAAAGCCAUUUU | 1310 | | IL13RA1:2290L21 antisense siNA (2272C) | AAUGGCUUUGAAAGGUCUUTT | 1730 |
| 408 | AAGGUGAUCCUGAGUCUGCUGUG | 1303 | | IL13RA1:410U21 sense siNA stab04 | B GGuGAuccuGAGucuGcuGTT B | 1731 |
| 657 | UGGUCAAGGAUAAUGCAGGAAAA | 1304 | | IL13RA1:659U21 sense siNA stab04 | B GucAAGGAuAAuGcAGGAATT B | 1732 |
| 871 | CGUCCAAGAGGCUAAAUGUGAGA | 1305 | | IL13RA1:873U21 sense siNA stab04 | B uccAAGAGGcuAAAuGuGATT B | 1733 |
| 1276 | GGAAACCGACUCUGUAGUGCUGA | 1306 | | IL13RA1:1278U21 sense siNA stab04 | B AAccGAcucuGuAGuGcuTT B | 1734 |
| 1308 | UGAAGAAAGCCUCUCAGUGAUGG | 1307 | | IL13RA1:1310U21 sense siNA stab04 | B AAGAAAGccucucAGuGAuTT B | 1735 |
| 1424 | ACUGCACCAUUUAAAAACAGGCA | 1308 | | IL13RA1:1426U21 sense siNA stab04 | B uGcAccAuuuAAAAAcAGGTT B | 1736 |
| 2186 | CAGCAUUUUCCUCUGCUUUGAAA | 1309 | | IL13RA1:2188U21 sense siNA stab04 | B GcAuuuuccucuGcuuuGATT B | 1737 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 2270 | CCAAGACCUUUCAAAGCCAUUUU | 1310 | | IL13RA1:2272U21 sense siNA stab04 | B AAGAccuucAAAGccAuuTT B | 1738 |
| 408 | AAGGUGAUCCUGAGUCUGCUGUG | 1303 | | IL13RA1:428L21 antisense siNA (410C) stab05 | cAGcAGAcucAGGAucAccTsT | 1739 |
| 657 | UGGUCAAGGAUAAUGCAGGAAAA | 1304 | | IL13RA1:677L21 antisense siNA (659C) stab05 | uuccuGcAuuAuccuuGAcTsT | 1740 |
| 871 | CGUCCAAGAGGCUAAAUGUGAGA | 1305 | | IL13RA1:891L21 antisense siNA (873C) stab05 | ucAcAuuuAGccucuuGGATsT | 1741 |
| 1276 | GGAAACCGACUCUGUAGUGCUGA | 1306 | | IL13RA1:1296L21 antisense siNA (1278C) stab05 | AGcAcuAcAGAGucGGuuuTsT | 1742 |
| 1308 | UGAAGAAAGCCUCUCAGUGAUGG | 1307 | | IL13RA1:1328L21 antisense siNA (1310C) stab05 | AucAcuGAGAGGcuuucuuTsT | 1743 |
| 1424 | ACUGCACCAUUUAAAAACAGGCA | 1308 | | IL13RA1:1444L21 antisense siNA (1426C) stab05 | ccuGuuuuuAAAuGGuGcATsT | 1744 |
| 2186 | CAGCAUUUUCCUCUGCUUUGAAA | 1309 | | IL13RA1:2206L21 antisense siNA (2188C) stab05 | ucAAAGcAGAGGAAAAuGcTsT | 1745 |
| 2270 | CCAAGACCUUUCAAAGCCAUUUU | 1310 | | IL13RA1:2290L21 antisense siNA (2272C) stab05 | AAuGGcuuuGAAAGGucuuTsT | 1746 |
| 408 | AAGGUGAUCCUGAGUCUGCUGUG | 1303 | | IL13RA1:410U21 sense siNA stab07 | B GGuGAuccuGAGucuGcuGTT B | 1747 |
| 657 | UGGUCAAGGAUAAUGCAGGAAAA | 1304 | | IL13RA1:659U21 sense siNA stab07 | B GucAAGGAuAAuGcAGGAATT B | 1748 |
| 871 | CGUCCAAGAGGCUAAAUGUGAGA | 1305 | | IL13RA1:873U21 sense siNA stab07 | B uccAAGAGGcuAAAuGuGATT B | 1749 |
| 1276 | GGAAACCGACUCUGUAGUGCUGA | 1306 | | IL13RA1:1278U21 sense siNA stab07 | B AAccGAcucuGuAGuGcuTT B | 1750 |
| 1308 | UGAAGAAAGCCUCUCAGUGAUGG | 1307 | | IL13RA1:1310U21 sense siNA stab07 | B AAGAAAGccucucAGuGAuTT B | 1751 |
| 1424 | ACUGCACCAUUUAAAAACAGGCA | 1308 | | IL13RA1:1426U21 sense siNA stab07 | B uGcAccAuuuAAAAAcAGGTT B | 1752 |
| 2186 | CAGCAUUUUCCUCUGCUUUGAAA | 1309 | | IL13RA1:2188U21 sense siNA stab07 | B GcAuuuuccucuGcuuuGATT B | 1753 |
| 2270 | CCAAGACCUUUCAAAGCCAUUUU | 1310 | | IL13RA1:2272U21 sense siNA stab07 | B AAGAccuucAAAGccAuuTT B | 1754 |
| 408 | AAGGUGAUCCUGAGUCUGCUGUG | 1303 | | IL13RA1:428L21 antisense siNA (410C) stab11 | cAGcAGAcucAGGAucAccTsT | 1755 |
| 657 | UGGUCAAGGAUAAUGCAGGAAAA | 1304 | | IL13RA1:677L21 antisense siNA (659C) stab11 | uuccuGcAuuAuccuuGAcTsT | 1756 |
| 871 | CGUCCAAGAGGCUAAAUGUGAGA | 1305 | | IL13RA1:891L21 antisense siNA (873C) stab11 | ucAcAuuuAGccucuuGGATsT | 1757 |
| 1276 | GGAAACCGACUCUGUAGUGCUGA | 1306 | | IL13RA1:1296L21 antisense siNA (1278C) stab11 | AGcAcuAcAGAGucGGuuuTsT | 1758 |
| 1308 | UGAAGAAAGCCUCUCAGUGAUGG | 1307 | | IL13RA1:1328L21 antisense siNA (1310C) stab11 | AucAcuGAGAGGcuuucuuTsT | 1759 |
| 1424 | ACUGCACCAUUUAAAAACAGGCA | 1308 | | IL13RA1:1444L21 antisense siNA (1426C) stab11 | ccuGuuuuuAAAuGGuGcATsT | 1760 |
| 2186 | CAGCAUUUUCCUCUGCUUUGAAA | 1309 | | IL13RA1:2206L21 antisense siNA (2188C) stab11 | ucAAAGcAGAGGAAAAuGcTsT | 1761 |
| 2270 | CCAAGACCUUUCAAAGCCAUUUU | 1310 | | IL13RA1:2290L21 antisense siNA (2272C) stab11 | AAuGGcuuuGAAAGGucuuTsT | 1762 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 408 | AAGGUGAUCCUGAGUCUGCUGUG | 1303 | | IL13RA1:410U21 sense siNA stab18 | B GGuGAuccuGAGucuGcuGTT B | 1763 |
| 657 | UGGUCAAGGAUAAUGCAGGAAAA | 1304 | | IL13RA1:659U21 sense siNA stab18 | B GucAAGGAuAAuGcAGGAATT B | 1764 |
| 871 | CGUCCAAGAGGCUAAAUGUGAGA | 1305 | | IL13RA1:873U21 sense siNA stab18 | B uccAAGAGGcuAAAuGuGATT B | 1765 |
| 1276 | GGAAACCGACUCUGUAGUGCUGA | 1306 | | IL13RA1:1278U21 sense siNA stab18 | B AAccGAcucuGuAGuGcuTT B | 1766 |
| 1308 | UGAAGAAAGCCUCUCAGUGAUGG | 1307 | | IL13RA1:1310U21 sense siNA stab18 | B AAGAAAGccucucAGuGAuTT B | 1767 |
| 1424 | ACUGCACCAUUUAAAAACAGGCA | 1308 | | IL13RA1:1426U21 sense siNA stab18 | B uGcAccAuuuAAAAAcAGGTT B | 1768 |
| 2186 | CAGCAUUUUCCUCUGCUUUGAAA | 1309 | | IL13RA1:2188U21 sense siNA stab18 | B GcAuuuuccucuGcuuuGATT B | 1769 |
| 2270 | CCAAGACCUUUCAAAGCCAUUUU | 1310 | | IL13RA1:2272U21 sense siNA stab18 | B AAGAccuuuAAAGccAuuTT B | 1770 |
| 408 | AAGGUGAUCCUGAGUCUGCUGUG | 1303 | | IL13RA1:428L21 antisense siNA (410C) stab08 | cAGcAGAcucAGGAucAccTsT | 1771 |
| 657 | UGGUCAAGGAUAAUGCAGGAAAA | 1304 | | IL13RA1:677L21 antisense siNA (659C) stab08 | uuccuGcAuuAuccuuGAcTsT | 1772 |
| 871 | 0GU00AAGAGG0UAAAUGUGAGA | 1305 | | L13RA1:891L21 antisense siNA (873C) stab08 | ucAcAuuuAGccucuuGGATsT | 1773 |
| 1276 | GGAAACCGACUCUGUAGUGCUGA | 1306 | | IL13RA1:1296L21 antisense siNA (1278C) stab08 | AGcAcuAcAGAGucGGuuuTsT | 1774 |
| 1308 | UGAAGAAAGCCUCUCAGUGAUGG | 1307 | | IL13RA1:1328L21 antisense siNA (1310C) stab08 | AucAcuGAGAGGcuuucuuTsT | 1775 |
| 1424 | ACUGCACCAUUUAAAAACAGGCA | 1308 | | IL13RA1:1444L21 antisense siNA (1426C) stab08 | ccuGuuuuuAAAuGGuGcATsT | 1776 |
| 2186 | CAGCAUUUUCCUCUGCUUUGAAA | 1309 | | IL13RA1:2206L21 antisense siNA (2188C) stab08 | ucAAAGcAGAGGAAAAuGcTsT | 1777 |
| 2270 | CCAAGACCUUUCAAAGCCAUUUU | 1310 | | IL13RA1:2290L21 antisense siNA (2272C) stab08 | AAuGGcuuuGAAAGGucuuTsT | 1778 |
| 408 | AAGGUGAUCCUGAGUCUGCUGUG | 1303 | 36906 | IL13RA1:410U21 sense siNA stab09 | B GGUGAUCCUGAGUCUGCUGTT B | 1779 |
| 657 | UGGUCAAGGAUAAUGCAGGAAAA | 1304 | 36907 | IL13RA1:659U21 sense siNA stab09 | B GUCAAGGAUAAUGCAGGAATT B | 1780 |
| 871 | CGUCCAAGAGGCUAAAUGUGAGA | 1305 | 36908 | IL13RA1:873U21 sense siNA stab09 | B UCCAAGAGGCUAAAUGUGATT B | 1781 |
| 1276 | GGAAACCGACUCUGUAGUGCUGA | 1306 | 36909 | IL13RA1:1278U21 sense siNA stab09 | B AAACCGACUCUGUAGUGCUTT B | 1782 |
| 1308 | UGAAGAAAGCCUCUCAGUGAUGG | 1307 | 36910 | IL13RA1:1310U21 sense siNA stab09 | B AAGAAAGCCUCUCAGUGAUTT B | 1783 |
| 1424 | ACUGCACCAUUUAAAAACAGGCA | 1308 | 36911 | IL13RA1:1426U21 sense siNA stab09 | B UGCACCAUUUAAAAACAGGTT B | 1784 |
| 2186 | CAGCAUUUUCCUCUGCUUUGAAA | 1309 | 36912 | IL13RA1:2188U21 sense siNA stab09 | B GCAUUUUCCUCUGCUUUGATT B | 1785 |
| 2270 | CCAAGACCUUUCAAAGCCAUUUU | 1310 | 36913 | IL13RA1:2272U21 sense siNA stab09 | B AAGACCUUUCAAAGCCAUUTT B | 1786 |
| 408 | AAGGUGAUCCUGAGUCUGCUGUG | 1303 | | IL13RA1:428L21 antisense siNA (410C) stab10 | CAGCAGACUCAGGAUCACCTsT | 1787 |

TABLE III-continued

Interleukin and Interleukin receptor Synthetic Modified siNA constructs

| Target Pos | Target | Seq ID | Cmpd# | Aliases | Sequence | Seq ID |
|---|---|---|---|---|---|---|
| 657 | UGGUCAAGGAUAAUGCAGGAAAA | 1304 | | IL13RA1:677L21 antisense siNA (659C) stab10 | UUCCUGCAUUAUCCUUGACTsT | 1788 |
| 871 | CGUCCAAGAGGCUAAAUGUGAGA | 1305 | | IL13RA1:891L21 antisense siNA (873C) stab10 | UCACAUUUAGCCUCUUGGATsT | 1789 |
| 1276 | GGAAACCGACUCUGUAGUGCUGA | 1306 | | IL13RA1:1296L21 antisense siNA (1278C) stab10 | AGCACUACAGAGUCGGUUUTsT | 1790 |
| 1308 | UGAAGAAAGCCUCUCAGUGAUGG | 1307 | | IL13RA1:1328L21 antisense siNA (1310C) stab10 | AUCACUGAGAGGCUUUCUUTsT | 1791 |
| 1424 | ACUGCACCAUUUAAAAACAGGCA | 1308 | | IL13RA1:1444L21 antisense siNA (1426C) stab10 | CCUGUUUUUAAAUGGUGCATsT | 1792 |
| 2186 | CAGCAUUUUCCUCUGCUUUGAAA | 1309 | | IL13RA1:2206L21 antisense siNA (2188C) stab10 | UCAAAGCAGAGGAAAAUGCTsT | 1793 |
| 2270 | CCAAGACCUUUCAAAGCCAUUUU | 1310 | | IL13RA1:2290L21 antisense siNA (2272C) stab10 | AAUGGCUUUGAAAGGUCUUTsT | 1794 |
| 408 | AAGGUGAUCCUGAGUCUGCUGUG | 1303 | | IL13RA1:428L21 antisense siNA (410C) stab19 | cAGcAGAcucAGGAucAccTT B | 1795 |
| 657 | UGGUCAAGGAUAAUGCAGGAAAA | 1304 | | IL13RA1:677L21 antisense siNA (659C) stab19 | uuccuGcAuuAuccuuGAcTT B | 1796 |
| 871 | CGUCCAAGAGGCUAAAUGUGAGA | 1305 | | IL13RA1:891L21 antisense siNA (873C) stab19 | ucAcAuuuAGccucuuGGATT B | 1797 |
| 1276 | GGAAACCGACUCUGUAGUGCUGA | 1306 | | IL13RA1:1296L21 antisense siNA (1278C) stab19 | AGcAcuAcAGAGucGGuuuTT B | 1798 |
| 1308 | UGAAGAAAGCCUCUCAGUGAUGG | 1307 | | IL13RA1:1328L21 antisense siNA (1310C) stab19 | AucAcuGAGAGGcuuucuuTT B | 1799 |
| 1424 | ACUGCACCAUUUAAAAACAGGCA | 1308 | | IL13RA1:1444L21 antisense siNA (1426C) stab19 | ccuGuuuuuAAAuGGuGcATT B | 1800 |
| 2186 | CAGCAUUUUCCUCUGCUUUGAAA | 1309 | | IL13RA1:2206L21 antisense siNA (2188C) stab19 | ucAAAGcAGAGGAAAAuGcTT B | 1801 |
| 2270 | CCAAGACCUUUCAAAGCCAUUUU | 1310 | | IL13RA1:2290L21 antisense siNA (2272C) stab19 | AAuGGcuuuGAAAGGucuuTT B | 1802 |
| 408 | AAGGUGAUCCUGAGUCUGCUGUG | 1303 | 36914 | IL13RA1:428L21 antisense siNA (410C) stab22 | CAGCAGACUCAGGAUCACCTT B | 1803 |
| 657 | UGGUCAAGGAUAAUGCAGGAAAA | 1304 | 36915 | IL13RA1:677L21 antisense siNA (659C) stab22 | UUCCUGCAUUAUCCUUGACTT B | 1804 |
| 871 | CGUCCAAGAGGCUAAAUGUGAGA | 1305 | 36916 | IL13RA1:891L21 antisense siNA (873C) stab22 | UCACAUUUAGCCUCUUGGATT B | 1805 |
| 1276 | GGAAACCGACUCUGUAGUGCUGA | 1306 | 36917 | IL13RA1:1296L21 antisense siNA (1278C) stab22 | AGCACUACAGAGUCGGUUUTT B | 1806 |
| 1308 | UGAAGAAAGCCUCUCAGUGAUGG | 1307 | 36918 | IL13RA1:1328L21 antisense siNA (1310C) stab22 | AUCACUGAGAGGCUUUCUUTT B | 1807 |
| 1424 | ACUGCACCAUUUAAAAACAGGCA | 1308 | 36919 | IL13RA1:1444L21 antisense siNA (1426C) stab22 | CCUGUUUUUAAAUGGUGCATT B | 1808 |
| 2186 | CAGCAUUUUCCUCUGCUUUGAAA | 1309 | 36920 | IL13RA1:2206L21 antisense siNA (2188C) stab22 | UCAAAGCAGAGGAAAAUGCTT B | 1809 |
| 2270 | CCAAGACCUUUCAAAGCCAUUUU | 1310 | 36921 | IL13RA1:2290L21 antisense siNA (2272C) stab22 | AAUGGCUUUGAAAGGUCUUTT B | 1810 |

Uppercase = ribonucleotide
u, c = 2'-deoxy-2'-fluoro U, C
T = thymidine
B = inverted deoxy abasic
s = phosphorothioate linkage TABLE III-continued Interleukin and Interleukin receptor Synthetic Modified siNA constructs

| Target Pos | Target | Seq ID | Cmpd# | Aliases | Sequence | Seq ID |
|---|---|---|---|---|---|---|

A = deoxy Adenosine
G = deoxy Guanosine
G = 2'-O-methyl Guanosine
A = 2'-O-methyl Adenosine

TABLE IV

Non-limiting examples of Stabilization Chemistries for chemically modified siNA constructs

| Chemistry | pyrimidine | Purine | cap | p = S | Strand |
|---|---|---|---|---|---|
| "Stab 00" | Ribo | Ribo | TT at 3'-ends | — | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | Usually AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | — | Usually S |
| "Stab 13" | 2'-fluoro | LNA | — | 1 at 3'-end | Usually AS |
| "Stab 14" | 2'-fluoro | 2'-deoxy | — | 2 at 5'-end 1 at 3'-end | Usually AS |
| "Stab 15" | 2'-deoxy | 2'-deoxy | — | 2 at 5'-end 1 at 3'-end | Usually AS |
| "Stab 16" | Ribo | 2'-O-Methyl | 5' and 3'-ends | — | Usually S |
| "Stab 17" | 2'-O-Methyl | 2'-O-Methyl | 5' and 3'-ends | — | Usually S |
| "Stab 18" | 2'-fluoro | 2'-O-Methyl | 5' and 3'-ends | 1 at 3'-end | Usually S |
| "Stab 19" | 2'-fluoro | 2'-O-Methyl | 3'-end | — | Usually AS |
| "Stab 20" | 2'-fluoro | 2'-deoxy | 3'-end | — | Usually AS |
| "Stab 21" | 2'-fluoro | Ribo | 3'-end | — | Usually AS |
| "Stab 22" | Ribo | Ribo | 3'-end | — | Usually AS |
| "Stab 23" | 2'-fluoro* | 2'-deoxy* | 5' and 3'-ends | — | Usually S |
| "Stab 24" | 2'-fluoro* | 2'-O-Methyl* | — | 1 at 3'-end | Usually AS |
| "Stab 25" | 2'-fluoro* | 2'-O-Methyl* | — | 1 at 3'-end | Usually AS |

Figure 10:
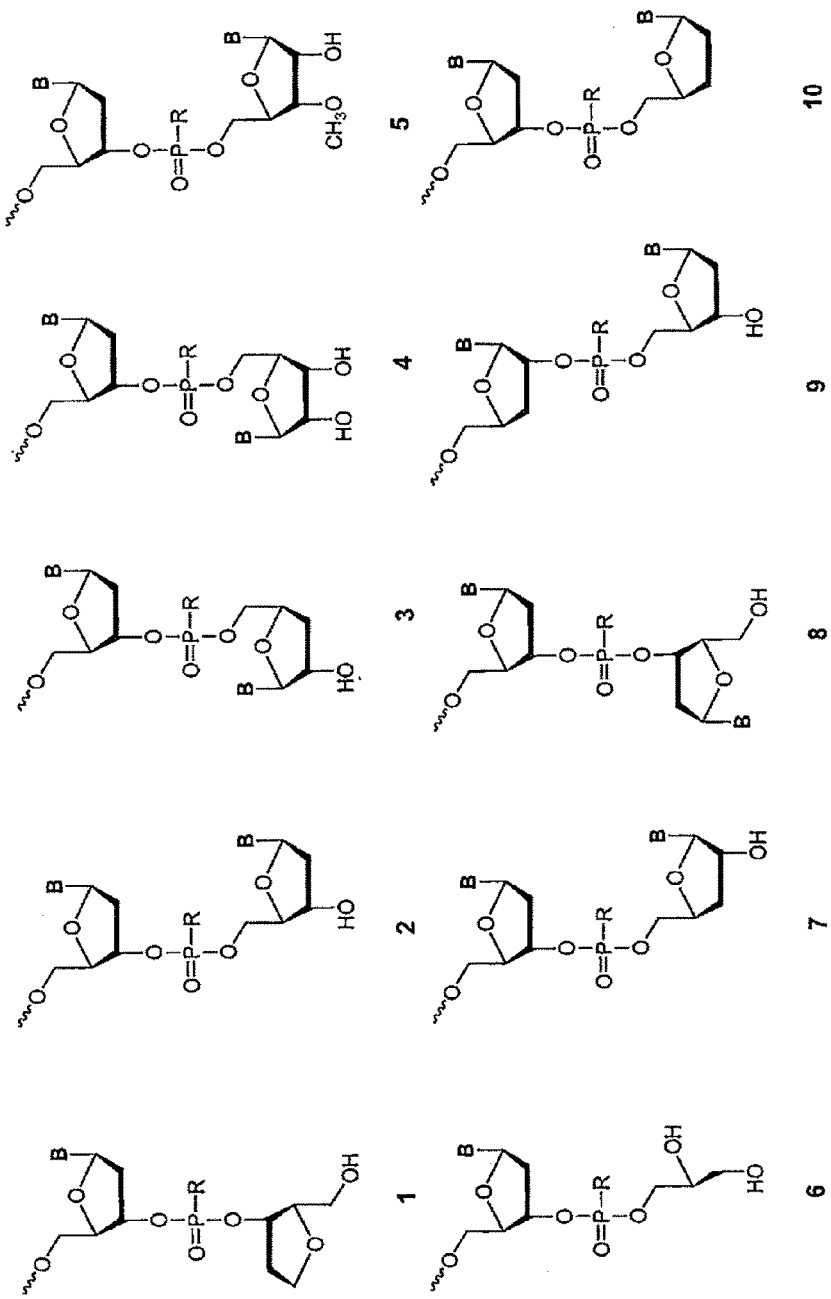
FIG. 10 shows non-limiting examples of different stabilization chemistries (1-10) that can be used, for example, to stabilize the 3'-end of siNA sequences of the invention, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide.

CAP = any terminal cap, see for example FIG. 10.
All Stab 1-25 chemistries can comprise 3'-terminal thymidine (TT) residues
All Stab 1-25 chemistries typically comprise about 21 nucleotides, but can vary as described herein.
S = sense strand
AS = antisense strand
*Stab 23 has single ribonucleotide adjacent to 3'-CAP
*Stab 24 has single ribonucleotide at 5'-terminus
*Stab 25 has three ribonucleotides at 5'-terminus

TABLE V

| Reagent | Equivalents | Amount | Wait Time* DNA | Wait Time* 2'-O-methyl | Wait Time* RNA |
|---|---|---|---|---|---|
| A. 2.5 μmol Synthesis Cycle ABI 394 Instrument | | | | | |
| Phosphoramidites | 6.5 | 163 μL | 45 sec | 2.5 min | 7.5 min |
| S-Ethyl Tetrazole | 23.8 | 238 μL | 45 sec | 2.5 min | 7.5 min |
| Acetic Anhydride | 100 | 233 μL | 5 sec | 5 sec | 5 sec |
| N-Methyl Imidazole | 186 | 233 μL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 μL | 100 sec | 300 sec | 300 sec |
| Acetonitrile | NA | 6.67 mL | NA | NA | NA |
| B. 0.2 μmol Synthesis Cycle ABI 394 Instrument | | | | | |
| Phosphoramidites | 15 | 31 μL | 45 sec | 233 sec | 465 sec |
| S-Ethyl Tetrazole | 38.7 | 31 μL | 45 sec | 233 min | 465 sec |
| Acetic Anhydride | 655 | 124 μL | 5 sec | 5 sec | 5 sec |
| N-Methyl Imidazole | 1245 | 124 μL | 5 sec | 5 sec | 5 sec |
| TCA | 700 | 732 μL | 10 sec | 10 sec | 10 sec |
| Iodine | 20.6 | 244 μL | 15 sec | 15 sec | 15 sec |
| Beaucage | 7.7 | 232 μL | 100 sec | 300 sec | 300 sec |
| Acetonitrile | NA | 2.64 mL | NA | NA | NA |

TABLE V-continued

C. 0.2 μmol Synthesis Cycle 96 well Instrument

| Reagent | Equivalents: DNA/ 2'-O-methyl/Ribo | Amount: DNA/2'-O-methyl/Ribo | Wait Time* DNA | Wait Time* 2'-O-methyl | Wait Time* Ribo |
|---|---|---|---|---|---|
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 min | 360 sec |
| Acetic Anhydride | 265/265/265 | 50/50/50 μL | 10 sec | 10 sec | 10 sec |
| N-Methyl Imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 | 100 sec | 200 sec | 200 sec |
| Acetonitrile | NA | 1150/1150/1150 μL | NA | NA NA | |

Wait time does not include contact time during delivery.
Tandem synthesis utilizes double coupling of linker molecule

SEQUENCE LISTING (1833 sequences)

SEQ ID NO: 1 - RNA, 19 nt, Artificial Sequence
  Synthetic Target Sequence/siNA sense region
agagcaagcgccauguuga

SEQ ID NO: 2 - RNA, 19 nt, Artificial Sequence
  Synthetic Target Sequence/siNA sense region
aagccaucauuaccauuca

SEQ ID NO: 3 - RNA, 19 nt, Artificial Sequence
  Synthetic Target Sequence/siNA sense region
acaucccucuuauuccugc

SEQ ID NO: 4 - RNA, 19 nt, Artificial Sequence
  Synthetic Target Sequence/siNA sense region
cagcugccccugcugggag

SEQ ID NO: 5 - RNA, 19 nt, Artificial Sequence
  Synthetic Target Sequence/siNA sense region
guggggcugaacacgacaa

SEQ ID NO: 6 - RNA, 19 nt, Artificial Sequence
  Synthetic Target Sequence/siNA sense region
auucugacgcccaauggga

SEQ ID NO: 7 - RNA, 19 nt, Artificial Sequence
  Synthetic Target Sequence/siNA sense region
aaugaagacaccacagcug

SEQ ID NO: 8 - RNA, 19 nt, Artificial Sequence
  Synthetic Target Sequence/siNA sense region
gauuucuuccugaccacua

SEQ ID NO: 9 - RNA, 19 nt, Artificial Sequence
  Synthetic Target Sequence/siNA sense region
augcccacugacucccuca

SEQ ID NO: 10 - RNA, 19 nt, Artificial Sequence
  Synthetic Target Sequence/siNA sense region
aguguuuccacucugcccc

SEQ ID NO: 11 - RNA, 19 nt, Artificial Sequence
  Synthetic Target Sequence/siNA sense region
cucccagagguucaguguu

SEQ ID NO: 12 - RNA, 19 nt, Artificial Sequence
  Synthetic Target Sequence/siNA sense region
uuuguguucaaugucgagu

SEQ ID NO: 13 - RNA, 19 nt, Artificial Sequence
  Synthetic Target Sequence/siNA sense region
uacaugaauugcacuugga

SEQ ID NO: 14 - RNA, 19 nt, Artificial Sequence
  Synthetic Target Sequence/siNA sense region
aacagcagcucugagcccc

SEQ ID NO: 15 - RNA, 19 nt, Artificial Sequence
  Synthetic Target Sequence/siNA sense region
cagccuaccaaccucacuc

SEQ ID NO: 16 - RNA, 19 nt, Artificial Sequence
  Synthetic Target Sequence/siNA sense region
cugcauuauugguacaaga

SEQ ID NO: 17 - RNA, 19 nt, Artificial Sequence
  Synthetic Target Sequence/siNA sense region
aacucggauaaugauaaag

SEQ ID NO: 18 - RNA, 19 nt, Artificial Sequence
  Synthetic Target Sequence/siNA sense region
guccagaagugcagccacu

SEQ ID NO: 19 - RNA, 19 nt, Artificial Sequence
  Synthetic Target Sequence/siNA sense region
uaucuauucucugaagaaa

SEQ ID NO: 20 - RNA, 19 nt, Artificial Sequence
  Synthetic Target Sequence/siNA sense region
aucacuucuggcugucagu

SEQ ID NO: 21 - RNA, 19 nt, Artificial Sequence
  Synthetic Target Sequence/siNA sense region
uugcaaaaaaaggagaucc

SEQ ID NO: 22 - RNA, 19 nt, Artificial Sequence
  Synthetic Target Sequence/siNA sense region
caccucuaccaaacauuug

SEQ ID NO: 23 - RNA, 19 nt, Artificial Sequence
  Synthetic Target Sequence/siNA sense region
guuguucagcuccaggacc

SEQ ID NO: 24 - RNA, 19 nt, Artificial Sequence
  Synthetic Target Sequence/siNA sense region
ccacgggaacccaggagac

SEQ ID NO: 25 - RNA, 19 nt, Artificial Sequence
  Synthetic Target Sequence/siNA sense region
caggccacacagaugcuaa

SEQ ID NO: 26 - RNA, 19 nt, Artificial Sequence
  Synthetic Target Sequence/siNA sense region
aaacugcagaaucugguga

SEQ ID NO: 27 - RNA, 19 nt, Artificial Sequence
  Synthetic Target Sequence/siNA sense region
auccccugggcuccagaga

SEQ ID NO: 28 - RNA, 19 nt, Artificial Sequence
  Synthetic Target Sequence/siNA sense region
aaccuaacacuucacaaac

SEQ ID NO: 29 - RNA, 19 nt, Artificial Sequence
  Synthetic Target Sequence/siNA sense region
cugagugaaucccagcuag

SEQ ID NO: 30 - RNA, 19 nt, Artificial Sequence
  Synthetic Target Sequence/siNA sense region
gaacugaacuggaacaaca

SEQ ID NO: 31 - RNA, 19 nt, Artificial Sequence
  Synthetic Target Sequence/siNA sense region
agauucuugaaccacuguu

SEQ ID NO: 32 - RNA, 19 nt, Artificial Sequence
  Synthetic Target Sequence/siNA sense region
uuggagcacuuggugcagu

SEQ ID NO: 33 - RNA, 19 nt, Artificial Sequence
  Synthetic Target Sequence/siNA sense region
uaccggacugacugggacc

SEQ ID NO: 34 - RNA, 19 nt, Artificial Sequence
  Synthetic Target Sequence/siNA sense region
cacagcuggacugaacaau

SEQ ID NO: 35 - RNA, 19 nt, Artificial Sequence
  Synthetic Target Sequence/siNA sense region
ucaguggauuauagacaua

SEQ ID NO: 36 - RNA, 19 nt, Artificial Sequence
  Synthetic Target Sequence/siNA sense region
aaguucuccuugccuagug

SEQ ID NO: 37 - RNA, 19 nt, Artificial Sequence
  Synthetic Target Sequence/siNA sense region
guggaugggcagaaacgcu

SEQ ID NO: 38 - RNA, 19 nt, Artificial Sequence
  Synthetic Target Sequence/siNA sense region
uacacguuucguguucgga

SEQ ID NO: 39 - RNA, 19 nt, Artificial Sequence
  Synthetic Target Sequence/siNA sense region
agccgcuuuaacccacucu

SEQ ID NO: 40 - RNA, 19 nt, Artificial Sequence
  Synthetic Target Sequence/siNA sense region
uguggaagugcucagcauu

SEQ ID NO: 41 - RNA, 19 nt, Artificial Sequence
  Synthetic Target Sequence/siNA sense region
uggagugaauggagccacc

SEQ ID NO: 42 - RNA, 19 nt, Artificial Sequence
  Synthetic Target Sequence/siNA sense region
ccaauccacugggggagca

SEQ ID NO: 43 - RNA, 19 nt, Artificial Sequence
  Synthetic Target Sequence/siNA sense region
aauacuucaaaagagaauc

SEQ ID NO: 44 - RNA, 19 nt, Artificial Sequence
  Synthetic Target Sequence/siNA sense region
ccuuuccuguuugcauugg

SEQ ID NO: 45 - RNA, 19 nt, Artificial Sequence
  Synthetic Target Sequence/siNA sense region
gaagccgugguuaucucug

SEQ ID NO: 46 - RNA, 19 nt, Artificial Sequence
  Synthetic Target Sequence/siNA sense region
guuggcuccaugggauuga

SEQ ID NO: 47 - RNA, 19 nt, Artificial Sequence
  Synthetic Target Sequence/siNA sense region
auuaucagccuucucugug

SEQ ID NO: 48 - RNA, 19 nt, Artificial Sequence
  Synthetic Target Sequence/siNA sense region
guguauuucuggcuggaac

SEQ ID NO: 49 - RNA, 19 nt, Artificial Sequence
  Synthetic Target Sequence/siNA sense region
cggacgaugccccgaauuc

SEQ ID NO: 50 - RNA, 19 nt, Artificial Sequence
  Synthetic Target Sequence/siNA sense region
cccacccugaagaaccuag

SEQ ID NO: 51 - RNA, 19 nt, Artificial Sequence
  Synthetic Target Sequence/siNA sense region
gaggaucuuguuacugaau

SEQ ID NO: 52 - RNA, 19 nt, Artificial Sequence
  Synthetic Target Sequence/siNA sense region
uaccacgggaacuuuucgg

SEQ ID NO: 53 - RNA, 19 nt, Artificial Sequence
  Synthetic Target Sequence/siNA sense region
gccuggaguggugugucua

SEQ ID NO: 54 - RNA, 19 nt, Artificial Sequence
  Synthetic Target Sequence/siNA sense region
aagggacuggcugagaguc

SEQ ID NO: 55 - RNA, 19 nt, Artificial Sequence
  Synthetic Target Sequence/siNA sense region
cugcagccagacuacagug

SEQ ID NO: 56 - RNA, 19 nt, Artificial Sequence
  Synthetic Target Sequence/siNA sense region
gaacgacucugccucguca

SEQ ID NO: 57 - RNA, 19 nt, Artificial Sequence
  Synthetic Target Sequence/siNA sense region
agugagauucccccaaaag

SEQ ID NO: 58 - RNA, 19 nt, Artificial Sequence
  Synthetic Target Sequence/siNA sense region
ggaggggcccuuggggagg

SEQ ID NO: 59 - RNA, 19 nt, Artificial Sequence
  Synthetic Target Sequence/siNA sense region
gggccuggggccuccccau

SEQ ID NO: 60 - RNA, 19 nt, Artificial Sequence
  Synthetic Target Sequence/siNA sense region
ugcaaccagcauagccccu

SEQ ID NO: 61 - RNA, 19 nt, Artificial Sequence
  Synthetic Target Sequence/siNA sense region
uacugggcccccccauguu

SEQ ID NO: 62 - RNA, 19 nt, Artificial Sequence
  Synthetic Target Sequence/siNA sense region
uacacccuaaagccugaaa

SEQ ID NO: 63 - RNA, 19 nt, Artificial Sequence
  Synthetic Target Sequence/siNA sense region
accugaaccccaauccucu

SEQ ID NO: 64 - RNA, 19 nt, Artificial Sequence
  Synthetic Target Sequence/siNA sense region
ugacagaagaaccccaggg

SEQ ID NO: 65 - RNA, 19 nt, Artificial Sequence
  Synthetic Target Sequence/siNA sense region
guccuguagcccuaagugg

SEQ ID NO: 66 - RNA, 19 nt, Artificial Sequence
  Synthetic Target Sequence/siNA sense region
guacuaacuuuccuucauu

SEQ ID NO: 67 - RNA, 19 nt, Artificial Sequence
  Synthetic Target Sequence/siNA sense region
ucaacccaccugcgucuca

SEQ ID NO: 68 - RNA, 19 nt, Artificial Sequence
  Synthetic Target Sequence/siNA sense region
auacucaccucaccccacu

SEQ ID NO: 69 - RNA, 19 nt, Artificial Sequence
  Synthetic Target Sequence/siNA sense region
uguggcugauuuggaauuu

SEQ ID NO: 70 - RNA, 19 nt, Artificial Sequence
  Synthetic Target Sequence/siNA sense region
uugugcccccauguaagca

SEQ ID NO: 71 - RNA, 19 nt, Artificial Sequence
  Synthetic Target Sequence/siNA sense region
accccuucauuuggcauuc

SEQ ID NO: 72 - RNA, 19 nt, Artificial Sequence
  Synthetic Target Sequence/siNA sense region
ccccacuugagaauuaccc

SEQ ID NO: 73 - RNA, 19 nt, Artificial Sequence
  Synthetic Target Sequence/siNA sense region
cuuuugccccgaacauguu

SEQ ID NO: 74 - RNA, 19 nt, Artificial Sequence
  Synthetic Target Sequence/siNA sense region
uuuucuucucccucagucu

SEQ ID NO: 75 - RNA, 19 nt, Artificial Sequence
  Synthetic Target Sequence/siNA sense region
uggcccuuccuuuucgcag

SEQ ID NO: 76 - RNA, 19 nt, Artificial Sequence
  Synthetic Target Sequence/siNA sense region
ggauucuuccucccucccu

SEQ ID NO: 77 - RNA, 19 nt, Artificial Sequence
  Synthetic Target Sequence/siNA sense region
ucuuucccucccuuccucu

SEQ ID NO: 78 - RNA, 19 nt, Artificial Sequence
  Synthetic Target Sequence/siNA sense region
uuuccaucuacccuccgau

SEQ ID NO: 79 - RNA, 19 nt, Artificial Sequence
  Synthetic Target Sequence/siNA sense region
uuguuccugaaccgaugag

SEQ ID NO: 80 - RNA, 19 nt, Artificial Sequence
  Synthetic Target Sequence/siNA sense region
gaaauaaaguuucuguuga

SEQ ID NO: 81 - RNA, 19 nt, Artificial Sequence
  Synthetic Target Sequence/siNA sense region
aaguuucuguugauaauca

SEQ ID NO: 82 - RNA, 19 nt, Artificial Sequence
  Synthetic siNA antisense region
ucaacauggcgcuugcucu

SEQ ID NO: 83 - RNA, 19 nt, Artificial Sequence
  Synthetic siNA antisense region
ugaaugguaaugauggcuu

SEQ ID NO: 84 - RNA, 19 nt, Artificial Sequence
  Synthetic siNA antisense region
gcaggaauaagagggaugu

SEQ ID NO: 85 - RNA, 19 nt, Artificial Sequence
  Synthetic siNA antisense region
cucccagcaggggcagcug

SEQ ID NO: 86 - RNA, 19 nt, Artificial Sequence
  Synthetic siNA antisense region
uugucguguucagccccac

SEQ ID NO: 87 - RNA, 19 nt, Artificial Sequence
  Synthetic siNA antisense region
ucccauugggcgucagaau

SEQ ID NO: 88 - RNA, 19 nt, Artificial Sequence
  Synthetic siNA antisense region
cagcuguggugucuucauu

SEQ ID NO: 89 - RNA, 19 nt, Artificial Sequence
  Synthetic siNA antisense region
uaguggucaggaagaaauc

SEQ ID NO: 90 - RNA, 19 nt, Artificial Sequence
  Synthetic siNA antisense region
ugagggagucagugggcau

SEQ ID NO: 91 - RNA, 19 nt, Artificial Sequence
  Synthetic siNA antisense region
ggggcagaguggaaacacu

SEQ ID NO: 92 - RNA, 19 nt, Artificial Sequence
  Synthetic siNA antisense region
aacacugaaccucugggag

SEQ ID NO: 93 - RNA, 19 nt, Artificial Sequence
  Synthetic siNA antisense region
acucgacauugaacacaaa

SEQ ID NO: 94 - RNA, 19 nt, Artificial Sequence
  Synthetic siNA antisense region
uccaagugcaauucaugua

SEQ ID NO: 95 - RNA, 19 nt, Artificial Sequence
  Synthetic siNA antisense region
ggggcucagagcugcuguu

SEQ ID NO: 96 - RNA, 19 nt, Artificial Sequence
  Synthetic siNA antisense region
gagugagguugguaggcug

SEQ ID NO: 97 - RNA, 19 nt, Artificial Sequence
  Synthetic siNA antisense region
ucuuguaccaauaaugcag

SEQ ID NO: 98 - RNA, 19 nt, Artificial Sequence
  Synthetic siNA antisense region
cuuuaucauuauccgaguu

SEQ ID NO: 99 - RNA, 19 nt, Artificial Sequence
  Synthetic siNA antisense region
aguggcugcacuucuggac

SEQ ID NO: 100 - RNA, 19 nt, Artificial Sequence
  Synthetic siNA antisense region
uuucuucagagaauagaua

SEQ ID NO: 101 - RNA, 19 nt, Artificial Sequence
  Synthetic siNA antisense region
acugacagccagaagugau

SEQ ID NO: 102 - RNA, 19 nt, Artificial Sequence
  Synthetic siNA antisense region
ggaucuccuuuuuuugcaa

SEQ ID NO: 103 - RNA, 19 nt, Artificial Sequence
  Synthetic siNA antisense region
caaauguuugguagaggug

SEQ ID NO: 104 - RNA, 19 nt, Artificial Sequence
  Synthetic siNA antisense region
gguccuggagcugaacaac

SEQ ID NO: 105 - RNA, 19 nt, Artificial Sequence
  Synthetic siNA antisense region
gucuccuggguucccgugg

SEQ ID NO: 106 - RNA, 19 nt, Artificial Sequence
  Synthetic siNA antisense region
uuagcaucuguguggccug

SEQ ID NO: 107 - RNA, 19 nt, Artificial Sequence
  Synthetic siNA antisense region
ucaccagauucugcaguuu

SEQ ID NO: 108 - RNA, 19 nt, Artificial Sequence
  Synthetic siNA antisense region
ucucuggagcccaggggau

SEQ ID NO: 109 - RNA, 19 nt, Artificial Sequence
  Synthetic siNA antisense region
guuugugaaguguuagguu

SEQ ID NO: 110 - RNA, 19 nt, Artificial Sequence
  Synthetic siNA antisense region
cuagcugggauucacucag

SEQ ID NO: 111 - RNA, 19 nt, Artificial Sequence
  Synthetic siNA antisense region
uguuguuccaguucaguuc

SEQ ID NO: 112 - RNA, 19 nt, Artificial Sequence
  Synthetic siNA antisense region
aacagugguucaagaaucu

SEQ ID NO: 113 - RNA, 19 nt, Artificial Sequence
  Synthetic siNA antisense region
acugcaccaagugcuccaa

SEQ ID NO: 114 - RNA, 19 nt, Artificial Sequence
  Synthetic siNA antisense region
ggucccagucaguccggua

SEQ ID NO: 115 - RNA, 19 nt, Artificial Sequence
  Synthetic siNA antisense region
auuguucaguccagcugug

SEQ ID NO: 116 - RNA, 19 nt, Artificial Sequence
  Synthetic siNA antisense region
uaugucuauaauccacuga

SEQ ID NO: 117 - RNA, 19 nt, Artificial Sequence
  Synthetic siNA antisense region
cacuaggcaaggagaacuu

SEQ ID NO: 118 - RNA, 19 nt, Artificial Sequence
  Synthetic siNA antisense region
agcguuucugcccauccac

SEQ ID NO: 119 - RNA, 19 nt, Artificial Sequence
  Synthetic siNA antisense region
uccgaacacgaaacgugua

SEQ ID NO: 120 - RNA, 19 nt, Artificial Sequence
  Synthetic siNA antisense region
agaguggguuaaagcggcu

SEQ ID NO: 121 - RNA, 19 nt, Artificial Sequence
  Synthetic siNA antisense region
aaugcugagcacuuccaca

SEQ ID NO: 122 - RNA, 19 nt, Artificial Sequence
  Synthetic siNA antisense region
gguggcuccauucacucca

SEQ ID NO: 123 - RNA, 19 nt, Artificial Sequence
  Synthetic siNA antisense region
ugcucccccaguggauugg

SEQ ID NO: 124 - RNA, 19 nt, Artificial Sequence
  Synthetic siNA antisense region
gauucucuuuugaaguauu

SEQ ID NO: 125 - RNA, 19 nt, Artificial Sequence
  Synthetic siNA antisense region
ccaaugcaaacaggaaagg

SEQ ID NO: 126 - RNA, 19 nt, Artificial Sequence
  Synthetic siNA antisense region
cagagauaaccacggcuuc

SEQ ID NO: 127 - RNA, 19 nt, Artificial Sequence
  Synthetic siNA antisense region
ucaaucccauggagccaac

SEQ ID NO: 128 - RNA, 19 nt, Artificial Sequence
  Synthetic siNA antisense region
cacagagaaggcugauaau

SEQ ID NO: 129 - RNA, 19 nt, Artificial Sequence
  Synthetic siNA antisense region
guuccagccagaaauacac

SEQ ID NO: 130 - RNA, 19 nt, Artificial Sequence
  Synthetic siNA antisense region
gaauucggggcaucguccg

SEQ ID NO: 131 - RNA, 19 nt, Artificial Sequence
  Synthetic siNA antisense region
cuagguucuucaggguggg

SEQ ID NO: 132 - RNA, 19 nt, Artificial Sequence
  Synthetic siNA antisense region
auucaguaacaagauccuc

SEQ ID NO: 133 - RNA, 19 nt, Artificial Sequence
  Synthetic siNA antisense region
ccgaaaaguucccguggua

SEQ ID NO: 134 - RNA, 19 nt, Artificial Sequence
  Synthetic siNA antisense region
uagacacaccacuccaggc

SEQ ID NO: 135 - RNA, 19 nt, Artificial Sequence
  Synthetic siNA antisense region
gacucucagccagucccuu

SEQ ID NO: 136 - RNA, 19 nt, Artificial Sequence
  Synthetic siNA antisense region
cacuguagucuggcugcag

SEQ ID NO: 137 - RNA, 19 nt, Artificial Sequence
  Synthetic siNA antisense region
ugacgaggcagagucguuc

SEQ ID NO: 138 - RNA, 19 nt, Artificial Sequence
  Synthetic siNA antisense region
cuuuugggggaaucucacu

SEQ ID NO: 139 - RNA, 19 nt, Artificial Sequence
  Synthetic siNA antisense region
ccuccccaagggccccucc

SEQ ID NO: 140 - RNA, 19 nt, Artificial Sequence
  Synthetic siNA antisense region
auggggaggccccaggccc

SEQ ID NO: 141 - RNA, 19 nt, Artificial Sequence
  Synthetic siNA antisense region
aggggcuaugcugguugca

SEQ ID NO: 142 - RNA, 19 nt, Artificial Sequence
  Synthetic siNA antisense region
aacaugggggggcccagua

SEQ ID NO: 143 - RNA, 19 nt, Artificial Sequence
  Synthetic siNA antisense region
uuucaggcuuuagggugua

SEQ ID NO: 144 - RNA, 19 nt, Artificial Sequence
  Synthetic siNA antisense region
agaggauugggguucaggu

SEQ ID NO: 145 - RNA, 19 nt, Artificial Sequence
  Synthetic siNA antisense region
cccugggguucuucuguca

SEQ ID NO: 146 - RNA, 19 nt, Artificial Sequence
  Synthetic siNA antisense region
ccacuuagggcuacaggac

SEQ ID NO: 147 - RNA, 19 nt, Artificial Sequence
  Synthetic siNA antisense region
aaugaaggaaaguuaguac

SEQ ID NO: 148 - RNA, 19 nt, Artificial Sequence
  Synthetic siNA antisense region
ugagacgcagguggguuga

SEQ ID NO: 149 - RNA, 19 nt, Artificial Sequence
  Synthetic siNA antisense region
aguggggugaggugaguau

SEQ ID NO: 150 - RNA, 19 nt, Artificial Sequence
  Synthetic siNA antisense region
aaauuccaaaucagccaca

SEQ ID NO: 151 - RNA, 19 nt, Artificial Sequence
  Synthetic siNA antisense region
ugcuuacaugggggcacaa

SEQ ID NO: 152 - RNA, 19 nt, Artificial Sequence
  Synthetic siNA antisense region
gaaugccaaaugaaggggu

SEQ ID NO: 153 - RNA, 19 nt, Artificial Sequence
  Synthetic siNA antisense region
ggguaauucucaagugggg

SEQ ID NO: 154 - RNA, 19 nt, Artificial Sequence
  Synthetic siNA antisense region
aacauguucggggcaaaag

SEQ ID NO: 155 - RNA, 19 nt, Artificial Sequence
  Synthetic siNA antisense region
agacugagggagaagaaaa

SEQ ID NO: 156 - RNA, 19 nt, Artificial Sequence
  Synthetic siNA antisense region
cugcgaaaaggaagggcca

SEQ ID NO: 157 - RNA, 19 nt, Artificial Sequence
  Synthetic siNA antisense region
agggagggaggaagaaucc

SEQ ID NO: 158 - RNA, 19 nt, Artificial Sequence
  Synthetic siNA antisense region
agaggaagggagggaaaga

SEQ ID NO: 159 - RNA, 19 nt, Artificial Sequence
  Synthetic siNA antisense region
aucggaggguagauggaaa

SEQ ID NO: 160 - RNA, 19 nt, Artificial Sequence
  Synthetic siNA antisense region
cucaucgguucaggaacaa

SEQ ID NO: 161 - RNA, 19 nt, Artificial Sequence
  Synthetic siNA antisense region
ucaacagaaacuuuauuuc

SEQ ID NO: 162 - RNA, 19 nt, Artificial Sequence
  Synthetic siNA antisense region
ugauuaucaacagaaacuu

SEQ ID NO: 163 - RNA, 19 nt, Artificial Sequence
  Synthetic Target Sequence/siNA sense region
cuaugcaaagcaaaaagcc

SEQ ID NO: 164 - RNA, 19 nt, Artificial Sequence
  Synthetic Target Sequence/siNA sense region
cagcagcagccccaagcug

SEQ ID NO: 165 - RNA, 19 nt, Artificial Sequence
  Synthetic Target Sequence/siNA sense region
gauaagauuaaucuaaaga

SEQ ID NO: 166 - RNA, 19 nt, Artificial Sequence
  Synthetic Target Sequence/siNA sense region
agcaaauuaugguguaauu

SEQ ID NO: 167 - RNA, 19 nt, Artificial Sequence
  Synthetic Target Sequence/siNA sense region
uuccuaugcugaaacuuug

SEQ ID NO: 168 - RNA, 19 nt, Artificial Sequence
  Synthetic Target Sequence/siNA sense region
guaguuaauuuuuuaaaaa

SEQ ID NO: 169 - RNA, 19 nt, Artificial Sequence
  Synthetic Target Sequence/siNA sense region
agguuucauuuuccuauug

SEQ ID NO: 170 - RNA, 19 nt, Artificial Sequence
  Synthetic Target Sequence/siNA sense region
ggucugauuucacaggaac

SEQ ID NO: 171 - RNA, 19 nt, Artificial Sequence
  Synthetic Target Sequence/siNA sense region
cauuuuaccuguuugugag

SEQ ID NO: 172 - RNA, 19 nt, Artificial Sequence
  Synthetic Target Sequence/siNA sense region
ggcauuuuuucuccuggaa

SEQ ID NO: 173 - RNA, 19 nt, Artificial Sequence
  Synthetic Target Sequence/siNA sense region
agagaggugcugauuggcc

SEQ ID NO: 174 - RNA, 19 nt, Artificial Sequence
  Synthetic Target Sequence/siNA sense region
cccaagugacugacaaucu

SEQ ID NO: 175 - RNA, 19 nt, Artificial Sequence
  Synthetic Target Sequence/siNA sense region
ugguguaacgaaaauuucc

SEQ ID NO: 176 - RNA, 19 nt, Artificial Sequence
  Synthetic Target Sequence/siNA sense region
caauguaaacucauuuucc

SEQ ID NO: 177 - RNA, 19 nt, Artificial Sequence
  Synthetic Target Sequence/siNA sense region
ccucgguuucagcaauuuu

SEQ ID NO: 178 - RNA, 19 nt, Artificial Sequence
  Synthetic Target Sequence/siNA sense region
uaaaucuauauauagagau

SEQ ID NO: 179 - RNA, 19 nt, Artificial Sequence
  Synthetic Target Sequence/siNA sense region
uaucuuugucagcauugca

SEQ ID NO: 180 - RNA, 19 nt, Artificial Sequence
  Synthetic Target Sequence/siNA sense region
aucguuagcuucuccugau

SEQ ID NO: 181 - RNA, 19 nt, Artificial Sequence
  Synthetic Target Sequence/siNA sense region
uaaacuaauugccucacau

SEQ ID NO: 182 - RNA, 19 nt, Artificial Sequence
  Synthetic Target Sequence/siNA sense region
uugucacugcaaaucgaca

SEQ ID NO: 183 - RNA, 19 nt, Artificial Sequence
  Synthetic Target Sequence/siNA sense region
accuauuaaugggucucac

SEQ ID NO: 184 - RNA, 19 nt, Artificial Sequence
  Synthetic Target Sequence/siNA sense region
ccucccaacugcuuccccc

SEQ ID NO: 185 - RNA, 19 nt, Artificial Sequence
  Synthetic Target Sequence/siNA sense region
cucuguucuuccugcuagc

SEQ ID NO: 186 - RNA, 19 nt, Artificial Sequence
  Synthetic Target Sequence/siNA sense region
caugugccggcaacuuugu

SEQ ID NO: 187 - RNA, 19 nt, Artificial Sequence
  Synthetic Target Sequence/siNA sense region
uccacggacacaagugcga

SEQ ID NO: 188 - RNA, 19 nt, Artificial Sequence
  Synthetic Target Sequence/siNA sense region
auaucaccuuacaggagau

SEQ ID NO: 189 - RNA, 19 nt, Artificial Sequence
  Synthetic Target Sequence/siNA sense region
ucaucaaaacuuugaacag

SEQ ID NO: 190 - RNA, 19 nt, Artificial Sequence
  Synthetic Target Sequence/siNA sense region
gccucacagagcagaagac

SEQ ID NO: 191 - RNA, 19 nt, Artificial Sequence
  Synthetic Target Sequence/siNA sense region
cucugugcaccgaguugac

SEQ ID NO: 192 - RNA, 19 nt, Artificial Sequence
  Synthetic Target Sequence/siNA sense region
ccguaacagacaucuuugc

SEQ ID NO: 193 - RNA, 19 nt, Artificial Sequence
  Synthetic Target Sequence/siNA sense region
cugccuccaagaacacaac

SEQ ID NO: 194 - RNA, 19 nt, Artificial Sequence
  Synthetic Target Sequence/siNA sense region
cugagaaggaaaccuucug

SEQ ID NO: 195 - RNA, 19 nt, Artificial Sequence
  Synthetic Target Sequence/siNA sense region
gcagggcugcgacugugcu

SEQ ID NO: 196 - RNA, 19 nt, Artificial Sequence
  Synthetic Target Sequence/siNA sense region
uccggcaguucuacagcca

SEQ ID NO: 197 - RNA, 19 nt, Artificial Sequence
  Synthetic Target Sequence/siNA ense region
accaugagaaggacacucg

SEQ ID NO: 198 - RNA, 19 nt, Artificial Sequence
  Synthetic Target Sequence/siNA sense region
gcugccugggugcgacugc

SEQ ID NO: 199 - RNA, 19 nt, Artificial Sequence
  Synthetic Target Sequence/siNA sense region
cacagcaguuccacaggca

SEQ ID NO: 200 - RNA, 19 nt, Artificial Sequence
  Synthetic Target Sequence/siNA sense region
acaagcagcugauccgauu

SEQ ID NO: 201 - RNA, 19 nt, Artificial Sequence
  Synthetic Target Sequence/siNA sense region
uccugaaacggcucgacag

SEQ ID NO: 202 - RNA, 19 nt, Artificial Sequence
  Synthetic Target Sequence/siNA sense region
ggaaccucuggggccuggc

SEQ ID NO: 203 - RNA, 19 nt, Artificial Sequence
  Synthetic Target Sequence/siNA sense region
cgggcuugaauuccugucc

SEQ ID NO: 204 - RNA, 19 nt, Artificial Sequence
  Synthetic Target Sequence/siNA sense region
cugugaaggaagccaacca

SEQ ID NO: 205 - RNA, 19 nt, Artificial Sequence
  Synthetic Target Sequence/siNA sense region
agaguacguuggaaaacuu

SEQ ID NO: 206 - RNA, 19 nt, Artificial Sequence
  Synthetic Target Sequence/siNA sense region
ucuuggaaaggcuaaagac

SEQ ID NO: 207 - RNA, 19 nt, Artificial Sequence
  Synthetic Target Sequence/siNA sense region
cgaucaugagagagaaaua

SEQ ID NO: 208 - RNA, 19 nt, Artificial Sequence
  Synthetic Target Sequence/siNA sense region
auucaaaguguucgagcug

SEQ ID NO: 209 - RNA, 19 nt, Artificial Sequence
  Synthetic Target Sequence/siNA sense region
gaauauuuuaauuuaugag

SEQ ID NO: 210 - RNA, 19 nt, Artificial Sequence
  Synthetic Target Sequence/siNA sense region
guuuuugauagcuuuauuu

SEQ ID NO: 211 - RNA, 19 nt, Artificial Sequence
  Synthetic Target Sequence/siNA sense region
uuuuaaguauuuauauauu

SEQ ID NO: 212 - RNA, 19 nt, Artificial Sequence
  Synthetic Target Sequence/siNA sense region
uuauaacucaucauaaaau

SEQ ID NO: 213 - RNA, 19 nt, Artificial Sequence
  Synthetic Target Sequence/siNA sense region
aauaaaguauauauagaau

SEQ ID NO: 214 - RNA, 19 nt, Artificial Sequence
  Synthetic siNA antisense region
ggcuuuuugcuuugcauag

SEQ ID NO: 215 - RNA, 19 nt, Artificial Sequence
  Synthetic siNA antisense region
cagcuuggggcugcugcug

SEQ ID NO: 216 - RNA, 19 nt, Artificial Sequence
  Synthetic siNA antisense region
ucuuuagauuaaucuuauc

SEQ ID NO: 217 - RNA, 19 nt, Artificial Sequence
  Synthetic siNA antisense region
aauuacaccauaauuugcu

SEQ ID NO: 218 - RNA, 19 nt, Artificial Sequence
  Synthetic siNA antisense region
caaaguuucagcauaggaa

SEQ ID NO: 219 - RNA, 19 nt, Artificial Sequence
  Synthetic siNA antisense region
uuuuuaaaaaauuaacuac

SEQ ID NO: 220 - RNA, 19 nt, Artificial Sequence
  Synthetic siNA antisense region
caauaggaaaaugaaaccu

SEQ ID NO: 221 - RNA, 19 nt, Artificial Sequence
  Synthetic siNA antisense region
guuccugugaaaucagacc

SEQ ID NO: 222 - RNA, 19 nt, Artificial Sequence
  Synthetic siNA antisense region
cucacaaacagguaaaaug

SEQ ID NO: 223 - RNA, 19 nt, Artificial Sequence
  Synthetic siNA antisense region
uuccaggagaaaaaaugcc

SEQ ID NO: 224 - RNA, 19 nt, Artificial Sequence
  Synthetic siNA antisense region
ggccaaucagcaccucucu

SEQ ID NO: 225 - RNA, 19 nt, Artificial Sequence
  Synthetic siNA antisense region
agauugucagucacuuggg

SEQ ID NO: 226 - RNA, 19 nt, Artificial Sequence
  Synthetic siNA antisense region
ggaaauuuucguuacacca

SEQ ID NO: 227 - RNA, 19 nt, Artificial Sequence
  Synthetic siNA antisense region
ggaaaaugaguuuacauug

SEQ ID NO: 228 - RNA, 19 nt, Artificial Sequence
  Synthetic siNA antisense region
aaaauugcugaaaccgagg

SEQ ID NO: 229 - RNA, 19 nt, Artificial Sequence
  Synthetic siNA antisense region
aucucuauauauagauuua

SEQ ID NO: 230 - RNA, 19 nt, Artificial Sequence
  Synthetic siNA antisense region
ugcaaugcugacaaagaua

SEQ ID NO: 231 - RNA, 19 nt, Artificial Sequence
  Synthetic siNA antisense region
aucaggagaagcuaacgau

SEQ ID NO: 232 - RNA, 19 nt, Artificial Sequence
  Synthetic siNA antisense region
augugaggcaauuaguuua

SEQ ID NO: 233 - RNA, 19 nt, Artificial Sequence
  Synthetic siNA antisense region
ugucgauuugcagugacaa

SEQ ID NO: 234 - RNA, 19 nt, Artificial Sequence
  Synthetic siNA antisense region
gugagacccauuaauaggu

SEQ ID NO: 235 - RNA, 19 nt, Artificial Sequence
  Synthetic siNA antisense region
gggggaagcaguugggagg

SEQ ID NO: 236 - RNA, 19 nt, Artificial Sequence
  Synthetic siNA antisense region
gcuagcaggaagaacagag

SEQ ID NO: 237 - RNA, 19 nt, Artificial Sequence
  Synthetic siNA antisense region
acaaaguugccggcacaug

SEQ ID NO: 238 - RNA, 19 nt, Artificial Sequence
  Synthetic siNA antisense region
ucgcacuuguguccgugga

SEQ ID NO: 239 - RNA, 19 nt, Artificial Sequence
  Synthetic siNA antisense region
aucuccuguaaggugauau

SEQ ID NO: 240 - RNA, 19 nt, Artificial Sequence
  Synthetic siNA antisense region
cuguucaaaguuuugauga

SEQ ID NO: 241 - RNA, 19 nt, Artificial Sequence
  Synthetic siNA antisense region
gucuucugcucugugaggc

SEQ ID NO: 242 - RNA, 19 nt, Artificial Sequence
  Synthetic siNA antisense region
gucaacucggugcacagag

SEQ ID NO: 243 - RNA, 19 nt, Artificial Sequence
  Synthetic siNA antisense region
gcaaagaugucuguuacgg

SEQ ID NO: 244 - RNA, 19 nt, Artificial Sequence
  Synthetic siNA antisense region
guuguguucuuggaggcag

SEQ ID NO: 245 - RNA, 19 nt, Artificial Sequence
  Synthetic siNA antisense region
cagaagguuuccuucucag

SEQ ID NO: 246 - RNA, 19 nt, Artificial Sequence
  Synthetic siNA antisense region
agcacagucgcagcccugc

SEQ ID NO: 247 - RNA, 19 nt, Artificial Sequence
  Synthetic siNA antisense region
uggcuguagaacugccgga

SEQ ID NO: 248 - RNA, 19 nt, Artificial Sequence
  Synthetic siNA antisense region
cgaguguccuucucauggu

SEQ ID NO: 249 - RNA, 19 nt, Artificial Sequence
  Synthetic siNA antisense region
gcagucgcacccaggcagc

SEQ ID NO: 250 - RNA, 19 nt, Artificial Sequence
  Synthetic siNA antisense region
ugccuguggaacugcugug

SEQ ID NO: 251 - RNA, 19 nt, Artificial Sequence
  Synthetic siNA antisense region
aaucggaucagcugcuugu

SEQ ID NO: 252 - RNA, 19 nt, Artificial Sequence
  Synthetic siNA antisense region
cugucgagccguuucagga

SEQ ID NO: 253 - RNA, 19 nt, Artificial Sequence
  Synthetic siNA antisense region
gccaggccccagagguucc

SEQ ID NO: 254 - RNA, 19 nt, Artificial Sequence
  Synthetic siNA antisense region
ggacaggaauucaagcccg

SEQ ID NO: 255 - RNA, 19 nt, Artificial Sequence
  Synthetic siNA antisense region
ugguuggcuuccuucacag

SEQ ID NO: 256 - RNA, 19 nt, Artificial Sequence
  Synthetic siNA antisense region
aaguuuuccaacguacucu

SEQ ID NO: 257 - RNA, 19 nt, Artificial Sequence
  Synthetic siNA antisense region
gucuuuagccuuuccaaga

SEQ ID NO: 258 - RNA, 19 nt, Artificial Sequence
  Synthetic siNA antisense region
uauuucucucucaugaucg

SEQ ID NO: 259 - RNA, 19 nt, Artificial Sequence
  Synthetic siNA antisense region
cagcucgaacacuuugaau

SEQ ID NO: 260 - RNA, 19 nt, Artificial Sequence
  Synthetic siNA antisense region
cucauaaauuaaaauauuc

SEQ ID NO: 261 - RNA, 19 nt, Artificial Sequence
  Synthetic siNA antisense region
aaauaaagcuaucaaaaac

SEQ ID NO: 262 - RNA, 19 nt, Artificial Sequence
  Synthetic siNA antisense region
aauauauaaauacuuaaaa

SEQ ID NO: 263 - RNA, 19 nt, Artificial Sequence
  Synthetic siNA antisense region
auuuuaugaugaguuauaa

SEQ ID NO: 264 - RNA, 19 nt, Artificial Sequence
  Synthetic siNA antisense region
auucuauauauacuuuauu

SEQ ID NO: 265 - RNA, 19 nt, Artificial Sequence
  Synthetic Target Sequence/siNA sense region
cgaauggagcaggggcgcg

SEQ ID NO: 266 - RNA, 19 nt, Artificial Sequence
  Synthetic Target Sequence/siNA sense region
gcagauaauuaaagauuua

SEQ ID NO: 267 - RNA, 19 nt, Artificial Sequence
  Synthetic Target Sequence/siNA sense region
acacacagcuggaagaaau

SEQ ID NO: 268 - RNA, 19 nt, Artificial Sequence
  Synthetic Target Sequence/siNA sense region
ucauagagaagccgggcgu

SEQ ID NO: 269 - RNA, 19 nt, Artificial Sequence
  Synthetic Target Sequence/siNA sense region
ugguggcucaugccuauaa

SEQ ID NO: 270 - RNA, 19 nt, Artificial Sequence
  Synthetic Target Sequence/siNA sense region
aucccagcacuuuuggagg

SEQ ID NO: 271 - RNA, 19 nt, Artificial Sequence
  Synthetic Target Sequence/siNA sense region
gcugaggcgggcagaucac

SEQ ID NO: 272 - RNA, 19 nt, Artificial Sequence
  Synthetic Target Sequence/siNA sense region
cuugagaucaggaguucga

SEQ ID NO: 273 - RNA, 19 nt, Artificial Sequence
  Synthetic Target Sequence/siNA sense region
agaccagccuggugccuug

SEQ ID NO: 274 - RNA, 19 nt, Artificial Sequence
  Synthetic Target Sequence/siNA sense region
ggcaucucccaauggggug

SEQ ID NO: 275 - RNA, 19 nt, Artificial Sequence
  Synthetic Target Sequence/siNA sense region
ggcuuugcucugggcuccu

SEQ ID NO: 276 - RNA, 19 nt, Artificial Sequence
  Synthetic Target Sequence/siNA sense region
uguucccugugagcugccu

SEQ ID NO: 277 - RNA, 19 nt, Artificial Sequence
  Synthetic Target Sequence/siNA sense region
ugguccugcugcagguggc

SEQ ID NO: 278 - RNA, 19 nt, Artificial Sequence
  Synthetic Target Sequence/siNA sense region
caagcucugggaacaugaa

SEQ ID NO: 279 - RNA, 19 nt, Artificial Sequence
  Synthetic Target Sequence/siNA sense region
aggucuugcaggagcccac

SEQ ID NO: 280 - RNA, 19 nt, Artificial Sequence
  Synthetic Target Sequence/siNA sense region
ccugcgucuccgacuacau

SEQ ID NO: 281 - RNA, 19 nt, Artificial Sequence
  Synthetic Target Sequence/siNA sense region
ugagcaucucuacuugcga

SEQ ID NO: 282 - RNA, 19 nt, Artificial Sequence
  Synthetic Target Sequence/siNA sense region
aguggaagaugaauggucc

SEQ ID NO: 283 - RNA, 19 nt, Artificial Sequence
  Synthetic Target Sequence/siNA sense region
ccaccaauugcagcaccga

SEQ ID NO: 284 - RNA, 19 nt, Artificial Sequence
  Synthetic Target Sequence/siNA sense region
agcuccgccuguuguacca

SEQ ID NO: 285 - RNA, 19 nt, Artificial Sequence
  Synthetic Target Sequence/siNA sense region
agcugguuuuucugcucuc

SEQ ID NO: 286 - RNA, 19 nt, Artificial Sequence
  Synthetic Target Sequence/siNA sense region
ccgaagcccacacguguau

SEQ ID NO: 287 - RNA, 19 nt, Artificial Sequence
  Synthetic Target Sequence/siNA sense region
ucccugagaacaacggagg

SEQ ID NO: 288 - RNA, 19 nt, Artificial Sequence
  Synthetic Target Sequence/siNA sense region
gcgcggggugcgugugcca

SEQ ID NO: 289 - RNA, 19 nt, Artificial Sequence
  Synthetic Target Sequence/siNA sense region
accugcucauggaugacgu

SEQ ID NO: 290 - RNA, 19 nt, Artificial Sequence
  Synthetic Target Sequence/siNA sense region
uggucagugcggauaacua

SEQ ID NO: 291 - RNA, 19 nt, Artificial Sequence
  Synthetic Target Sequence/siNA sense region
auacacuggaccugugggc

SEQ ID NO: 292 - RNA, 19 nt, Artificial Sequence
  Synthetic Target Sequence/siNA sense region
cugggcagcagcugcugug

SEQ ID NO: 293 - RNA, 19 nt, Artificial Sequence
  Synthetic Target Sequence/siNA sense region
ggaagggcuccuucaagcc

SEQ ID NO: 294 - RNA, 19 nt, Artificial Sequence
  Synthetic Target Sequence/siNA sense region
ccagcgagcaugugaaacc

SEQ ID NO: 295 - RNA, 19 nt, Artificial Sequence
  Synthetic Target Sequence/siNA sense region
ccagggccccaggaaaccu

SEQ ID NO: 296 - RNA, 19 nt, Artificial Sequence
  Synthetic Target Sequence/siNA sense region
ugacaguucacaccaaugu

SEQ ID NO: 297 - RNA, 19 nt, Artificial Sequence
  Synthetic Target Sequence/siNA sense region
ucuccgacacucugcugcu

SEQ ID NO: 298 - RNA, 19 nt, Artificial Sequence
  Synthetic Target Sequence/siNA sense region
ugaccuggagcaacccgua

SEQ ID NO: 299 - RNA, 19 nt, Artificial Sequence
  Synthetic Target Sequence/siNA sense region
aucccccugacaauuaccu

SEQ ID NO: 300 - RNA, 19 nt, Artificial Sequence
  Synthetic Target Sequence/siNA sense region
uguauaaucaucucaccua

SEQ ID NO: 301 - RNA, 19 nt, Artificial Sequence
  Synthetic Target Sequence/siNA sense region
augcagucaacauuuggag

SEQ ID NO: 302 - RNA, 19 nt, Artificial Sequence
  Synthetic Target Sequence/siNA sense region
gugaaaacgacccggcaga

SEQ ID NO: 303 - RNA, 19 nt, Artificial Sequence
  Synthetic Target Sequence/siNA sense region
auuucagaaucuauaacgu

SEQ ID NO: 304 - RNA, 19 nt, Artificial Sequence
  Synthetic Target Sequence/siNA sense region
ugaccuaccuagaacccuc

SEQ ID NO: 305 - RNA, 19 nt, Artificial Sequence
  Synthetic Target Sequence/siNA sense region
cccuccgcaucgcagccag

SEQ ID NO: 306 - RNA, 19 nt, Artificial Sequence
  Synthetic Target Sequence/siNA sense region
gcacccugaagucugggau

SEQ ID NO: 307 - RNA, 19 nt, Artificial Sequence
  Synthetic Target Sequence/siNA sense region
uuuccuacagggcacgggu

SEQ ID NO: 308 - RNA, 19 nt, Artificial Sequence
  Synthetic Target Sequence/siNA sense region
ugagggccugggcucagug

SEQ ID NO: 309 - RNA, 19 nt, Artificial Sequence
  Synthetic Target Sequence/siNA sense region
gcuauaacaccaccuggag

SEQ ID NO: 310 - RNA, 19 nt, Artificial Sequence
  Synthetic Target Sequence/siNA sense region
gugaguggagccccagcac

SEQ ID NO: 311 - RNA, 19 nt, Artificial Sequence
  Synthetic Target Sequence/siNA sense region
ccaaguggcacaacuccua

SEQ ID NO: 312 - RNA, 19 nt, Artificial Sequence
  Synthetic Target Sequence/siNA sense region
acagggagcccuucgagca

SEQ ID NO: 313 - RNA, 19 nt, Artificial Sequence
  Synthetic Target Sequence/siNA sense region
agcaccuccugcugggcgu

SEQ ID NO: 314 - RNA, 19 nt, Artificial Sequence
  Synthetic Target Sequence/siNA sense region
ucagcguuuccugcauugu

SEQ ID NO: 315 - RNA, 19 nt, Artificial Sequence
  Synthetic Target Sequence/siNA sense region
ucauccuggccgucugccu

SEQ ID NO: 316 - RNA, 19 nt, Artificial Sequence
  Synthetic Target Sequence/siNA sense region
uguugugcuaugucagcau

SEQ ID NO: 317 - RNA, 19 nt, Artificial Sequence
  Synthetic Target Sequence/siNA sense region
ucaccaagauuaagaaaga

SEQ ID NO: 318 - RNA, 19 nt, Artificial Sequence
  Synthetic Target Sequence/siNA sense region
aauggugggaucagauucc

SEQ ID NO: 319 - RNA, 19 nt, Artificial Sequence
  Synthetic Target Sequence/siNA sense region
ccaacccagcccgcagccg

SEQ ID NO: 320 - RNA, 19 nt, Artificial Sequence
  Synthetic Target Sequence/siNA sense region
gccucguggcuauaauaau

SEQ ID NO: 321 - RNA, 19 nt, Artificial Sequence
  Synthetic Target Sequence/siNA sense region
uccaggaugcucagggguc

SEQ ID NO: 322 - RNA, 19 nt, Artificial Sequence
  Synthetic Target Sequence/siNA sense region
cacagugggagaagcgguc

SEQ ID NO: 323 - RNA, 19 nt, Artificial Sequence
  Synthetic Target Sequence/siNA sense region
cccgaggccaggaaccagc

SEQ ID NO: 324 - RNA, 19 nt, Artificial Sequence
  Synthetic Target Sequence/siNA sense region
ccaagugcccacacuggaa

SEQ ID NO: 325 - RNA, 19 nt, Artificial Sequence
  Synthetic Target Sequence/siNA sense region
agaauugucuuaccaagcu

SEQ ID NO: 326 - RNA, 19 nt, Artificial Sequence
  Synthetic Target Sequence/siNA sense region
ucuugcccuguuuucugga

SEQ ID NO: 327 - RNA, 19 nt, Artificial Sequence
  Synthetic Target Sequence/siNA sense region
agcacaacaugaaaaggga

SEQ ID NO: 328 - RNA, 19 nt, Artificial Sequence
  Synthetic Target Sequence/siNA sense region
augaagauccucacaaggc

SEQ ID NO: 329 - RNA, 19 nt, Artificial Sequence
  Synthetic Target Sequence/siNA sense region
cugccaaagagaugccuuu

SEQ ID NO: 330 - RNA, 19 nt, Artificial Sequence
  Synthetic Target Sequence/siNA sense region
uccagggcucuggaaaauc

SEQ ID NO: 331 - RNA, 19 nt, Artificial Sequence
  Synthetic Target Sequence/siNA sense region
cagcauggugcccagugga

SEQ ID NO: 332 - RNA, 19 nt, Artificial Sequence
  Synthetic Target Sequence/siNA sense region
agaucagcaagacaguccu

SEQ ID NO: 333 - RNA, 19 nt, Artificial Sequence
  Synthetic Target Sequence/siNA sense region
ucuggccagagagcaucag

SEQ ID NO: 334 - RNA, 19 nt, Artificial Sequence
  Synthetic Target Sequence/siNA sense region
gcguggugcgaugugugga

SEQ ID NO: 335 - RNA, 19 nt, Artificial Sequence
  Synthetic Target Sequence/siNA sense region
aguuguuugaggccccggu

SEQ ID NO: 336 - RNA, 19 nt, Artificial Sequence
  Synthetic Target Sequence/siNA sense region
uggagugugaggaggagga

SEQ ID NO: 337 - RNA, 19 nt, Artificial Sequence
  Synthetic Target Sequence/siNA sense region
aggagguagaggaagaaaa

SEQ ID NO: 338 - RNA, 19 nt, Artificial Sequence
  Synthetic Target Sequence/siNA sense region
aagggagcuucugugcauc

SEQ ID NO: 339 - RNA, 19 nt, Artificial Sequence
  Synthetic Target Sequence/siNA sense region
cgccugagagcagcaggga

SEQ ID NO: 340 - RNA, 19 nt, Artificial Sequence
  Synthetic Target Sequence/siNA sense region
augacuuccaggagggaag

SEQ ID NO: 341 - RNA, 19 nt, Artificial Sequence
  Synthetic Target Sequence/siNA sense region n
gggagggcauuguggcccg

SEQ ID NO: 342 - RNA, 19 nt, Artificial Sequence
  Synthetic Target Sequence/siNA sense region
ggcuaacagagagccuguu

SEQ ID NO: 343 - RNA, 19 nt, Artificial Sequence
  Synthetic Target Sequence/siNA sense region
uccuggaccugcucggaga

SEQ ID NO: 344 - RNA, 19 nt, Artificial Sequence
  Synthetic Target Sequence/siNA sense region
aggagaaugggggcuuuug

SEQ ID NO: 345 - RNA, 19 nt, Artificial Sequence
  Synthetic Target Sequence/siNA sense region
gccagcaggacauggggga

SEQ ID NO: 346 - RNA, 19 nt, Artificial Sequence
  Synthetic Target Sequence/siNA sense region
agucaugccuucuuccacc

SEQ ID NO: 347 - RNA, 19 nt, Artificial Sequence
  Synthetic Target Sequence/siNA sense region
cuucgggaaguacgagugc

SEQ ID NO: 348 - RNA, 19 nt, Artificial Sequence
  Synthetic Target Sequence/siNA sense region
cucacaugcccugggauga

SEQ ID NO: 349 - RNA, 19 nt, Artificial Sequence
  Synthetic Target Sequence/siNA sense region
aguucccaagugcagggcc

SEQ ID NO: 350 - RNA, 19 nt, Artificial Sequence
  Synthetic Target Sequence/siNA sense region
ccaaggaggcaccucccug

SEQ ID NO: 351 - RNA, 19 nt, Artificial Sequence
  Synthetic Target Sequence/siNA sense region
ggggcaaggagcagccucu

SEQ ID NO: 352 - RNA, 19 nt, Artificial Sequence
  Synthetic Target Sequence/siNA sense region
uccaccuggagccaagucc

SEQ ID NO: 353 - RNA, 19 nt, Artificial Sequence
  Synthetic Target Sequence/siNA sense region
cuccugccagcccgaccca

SEQ ID NO: 354 - RNA, 19 nt, Artificial Sequence
  Synthetic Target Sequence/siNA sense region
agaguccagacaaccugac

SEQ ID NO: 355 - RNA, 19 nt, Artificial Sequence
  Synthetic Target Sequence/siNA sense region
cuugcacagagacgccccu

SEQ ID NO: 356 - RNA, 19 nt, Artificial Sequence
  Synthetic Target Sequence/siNA sense region
ucgucaucgcaggcaaccc

SEQ ID NO: 357 - RNA, 19 nt, Artificial Sequence
  Synthetic Target Sequence/siNA sense region
cugcuuaccgcagcuucag

SEQ ID NO: 358 - RNA, 19 nt, Artificial Sequence
  Synthetic Target Sequence/siNA sense region
gcaacucccugagccaguc

SEQ ID NO: 359 - RNA, 19 nt, Artificial Sequence
  Synthetic Target Sequence/siNA sense region
caccgugucccagagagcu

SEQ ID NO: 360 - RNA, 19 nt, Artificial Sequence
  Synthetic Target Sequence/siNA sense region
uggguccagacccacugcu

SEQ ID NO: 361 - RNA, 19 nt, Artificial Sequence
  Synthetic Target Sequence/siNA sense region
uggccagacaccuggagga

SEQ ID NO: 362 - RNA, 19 nt, Artificial Sequence
  Synthetic Target Sequence/siNA sense region
aaguagaacccgagaugcc

SEQ ID NO: 363 - RNA, 19 nt, Artificial Sequence
  Synthetic Target Sequence/siNA sense region
ccugugucccccagcucuc

SEQ ID NO: 364 - RNA, 19 nt, Artificial Sequence
  Synthetic Target Sequence/siNA sense region
cugagccaaccacugugcc

SEQ ID NO: 365 - RNA, 19 nt, Artificial Sequence
  Synthetic Target Sequence/siNA sense region
cccaaccugagccagaaac

SEQ ID NO: 366 - RNA, 19 nt, Artificial Sequence
  Synthetic Target Sequence/siNA sense region
ccugggagcagauccuccg

SEQ ID NO: 367 - RNA, 19 nt, Artificial Sequence
  Synthetic Target Sequence/siNA sense region
gccgaaauguccuccagca

SEQ ID NO: 368 - RNA, 19 nt, Artificial Sequence
  Synthetic Target Sequence/siNA sense region
auggggcagcugcagcccc

SEQ ID NO: 369 - RNA, 19 nt, Artificial Sequence
  Synthetic Target Sequence/siNA sense region
ccgucucggcccccaccag

SEQ ID NO: 370 - RNA, 19 nt, Artificial Sequence
  Synthetic Target Sequence/siNA sense region
guggcuaucaggaguuugu

SEQ ID NO: 371 - RNA, 19 nt, Artificial Sequence
  Synthetic Target Sequence/siNA sense region
uacaugcgguggagcaggg

SEQ ID NO: 372 - RNA, 19 nt, Artificial Sequence
  Synthetic Target Sequence/siNA sense region
guggcacccaggccagugc

SEQ ID NO: 373 - RNA, 19 nt, Artificial Sequence
  Synthetic Target Sequence/siNA sense region
cgguggugggcuugggucc

SEQ ID NO: 374 - RNA, 19 nt, Artificial Sequence
  Synthetic Target Sequence/siNA sense region
ccccaggagaggcugguua

SEQ ID NO: 375 - RNA, 19 nt, Artificial Sequence
  Synthetic Target Sequence/siNA sense region
acaaggccuucucaagccu

SEQ ID NO: 376 - RNA, 19 nt, Artificial Sequence
  Synthetic Target Sequence/siNA sense region
ugcuugccagcagugcugu

SEQ ID NO: 377 - RNA, 19 nt, Artificial Sequence
  Synthetic Target Sequence/siNA sense region
uguccccagagaaaugugg

SEQ ID NO: 378 - RNA, 19 nt, Artificial Sequence
  Synthetic Target Sequence/siNA sense region
gguuuggggcuagcagugg

SEQ ID NO: 379 - RNA, 19 nt, Artificial Sequence
  Synthetic Target Sequence/siNA sense region
gggaagagggguauaagcc

SEQ ID NO: 380 - RNA, 19 nt, Artificial Sequence
  Synthetic Target Sequence/siNA sense region
cuuuccaagaccucauucc

SEQ ID NO: 381 - RNA, 19 nt, Artificial Sequence
  Synthetic Target Sequence/siNA sense region
cuggcugcccuggggaccc

SEQ ID NO: 382 - RNA, 19 nt, Artificial Sequence
  Synthetic Target Sequence/siNA sense region
cugccccagucccuguccc

SEQ ID NO: 383 - RNA, 19 nt, Artificial Sequence
  Synthetic Target Sequence/siNA sense region
ccuuguucaccuuuggacu

SEQ ID NO: 384 - RNA, 19 nt, Artificial Sequence
  Synthetic Target Sequence/siNA sense region
uggacagggagccaccucg

SEQ ID NO: 385 - RNA, 19 nt, Artificial Sequence
  Synthetic Target Sequence/siNA sense region
gcaguccgcagagcucaca

SEQ ID NO: 386 - RNA, 19 nt, Artificial Sequence
  Synthetic Target Sequence/siNA sense region
aucucccaagcagcucccc

SEQ ID NO: 387 - RNA, 19 nt, Artificial Sequence
  Synthetic Target Sequence/siNA sense region
cagagcaccugggucugga

SEQ ID NO: 388 - RNA, 19 nt, Artificial Sequence
  Synthetic Target Sequence/siNA sense region
agccgggggaaaagguaga

SEQ ID NO: 389 - RNA, 19 nt, Artificial Sequence
  Synthetic Target Sequence/siNA sense region
aggacaugccaaagccccc

SEQ ID NO: 390 - RNA, 19 nt, Artificial Sequence
  Synthetic Target Sequence/siNA sense region
cacuuccccaggagcaggc

SEQ ID NO: 391 - RNA, 19 nt, Artificial Sequence
  Synthetic Target Sequence/siNA sense region
ccacagacccccuugugga

SEQ ID NO: 392 - RNA, 19 nt, Artificial Sequence
  Synthetic Target Sequence/siNA sense region
acagccugggcaguggcau

SEQ ID NO: 393 - RNA, 19 nt, Artificial Sequence
  Synthetic Target Sequence/siNA sense region
uugucuacucagcccuuac

SEQ ID NO: 394 - RNA, 19 nt, Artificial Sequence
  Synthetic Target Sequence/siNA sense region
ccugccaccugugcggcca

SEQ ID NO: 395 - RNA, 19 nt, Artificial Sequence
  Synthetic Target Sequence/siNA sense region
accugaaacagugucaugg

SEQ ID NO: 396 - RNA, 19 nt, Artificial Sequence
  Synthetic Target Sequence/siNA sense region
gccaggaggaugguggcca

SEQ ID NO: 397 - RNA, 19 nt, Artificial Sequence
  Synthetic Target Sequence/siNA sense region
agaccccugucauggccag

SEQ ID NO: 398 - RNA, 19 nt, Artificial Sequence
  Synthetic Target Sequence/siNA sense region
guccuugcuguggcugcug

SEQ ID NO: 399 - RNA, 19 nt, Artificial Sequence
  Synthetic Target Sequence/siNA sense region
gcuguggagacagguccuc

SEQ ID NO: 400 - RNA, 19 nt, Artificial Sequence
  Synthetic Target Sequence/siNA sense region
cgcccccuacaaccccccu

SEQ ID NO: 401 - RNA, 19 nt, Artificial Sequence
  Synthetic Target Sequence/siNA sense region
ugagggccccagaccccuc

SEQ ID NO: 402 - RNA, 19 nt, Artificial Sequence
  Synthetic Target Sequence/siNA sense region
cuccaggugggguuccacu

SEQ ID NO: 403 - RNA, 19 nt, Artificial Sequence
  Synthetic Target Sequence/siNA sense region
uggaggccagucugugucc

SEQ ID NO: 404 - RNA, 19 nt, Artificial Sequence
  Synthetic Target Sequence/siNA sense region
cggccucccuggcacccuc

SEQ ID NO: 405 - RNA, 19 nt, Artificial Sequence
  Synthetic Target Sequence/siNA sense region
cgggcaucucagagaagag

SEQ ID NO: 406 - RNA, 19 nt, Artificial Sequence
  Synthetic Target Sequence/siNA sense region
guaaauccucaucauccuu

SEQ ID NO: 407 - RNA, 19 nt, Artificial Sequence
  Synthetic Target Sequence/siNA sense region
uccauccugccccuggcaa

SEQ ID NO: 408 - RNA, 19 nt, Artificial Sequence
  Synthetic Target Sequence/siNA sense region
augcucagagcucaagcca

SEQ ID NO: 409 - RNA, 19 nt, Artificial Sequence
  Synthetic Target Sequence/siNA sense region
agacccccaaaaucgugaa

SEQ ID NO: 410 - RNA, 19 nt, Artificial Sequence
  Synthetic Target Sequence/siNA sense region
acuuugucuccgugggacc

SEQ ID NO: 411 - RNA, 19 nt, Artificial Sequence
  Synthetic Target Sequence/siNA sense region
ccacauacaugagggucuc

SEQ ID NO: 412 - RNA, 19 nt, Artificial Sequence
  Synthetic Target Sequence/siNA sense region
cuuaggugcauguccucuu

SEQ ID NO: 413 - RNA, 19 nt, Artificial Sequence
  Synthetic Target Sequence/siNA sense region
uguugcugagucugcagau

SEQ ID NO: 414 - RNA, 19 nt, Artificial Sequence
  Synthetic Target Sequence/siNA sense region
ugaggacuagggcuuaucc

SEQ ID NO: 415 - RNA, 19 nt, Artificial Sequence
  Synthetic Target Sequence/siNA sense region
caugccugggaaaugccac

SEQ ID NO: 416 - RNA, 19 nt, Artificial Sequence
  Synthetic Target Sequence/siNA sense region
ccuccuggaaggcagccag

SEQ ID NO: 417 - RNA, 19 nt, Artificial Sequence
  Synthetic Target Sequence/siNA sense region
ggcuggcagauuuccaaaa

SEQ ID NO: 418 - RNA, 19 nt, Artificial Sequence
  Synthetic Target Sequence/siNA sense region
agacuugaagaaccauggu

SEQ ID NO: 419 - RNA, 19 nt, Artificial Sequence
  Synthetic Target Sequence/siNA sense region
uaugaaggugauuggcccc

SEQ ID NO: 420 - RNA, 19 nt, Artificial Sequence
  Synthetic Target Sequence/siNA sense region
cacugacguuggccuaaca

SEQ ID NO: 421 - RNA, 19 nt, Artificial Sequence
  Synthetic Target Sequence/siNA sense region
acugggcugcagagacugg

SEQ ID NO: 422 - RNA, 19 nt, Artificial Sequence
  Synthetic Target Sequence/siNA sense region
gaccccgcccagcauuggg

SEQ ID NO: 423 - RNA, 19 nt, Artificial Sequence
  Synthetic Target Sequence/siNA sense region
gcugggcucgccacauccc

SEQ ID NO: 424 - RNA, 19 nt, Artificial Sequence
  Synthetic Target Sequence/siNA sense region
caugagaguagagggcacu

SEQ ID NO: 425 - RNA, 19 nt, Artificial Sequence
  Synthetic Target Sequence/siNA sense region
ugggucgccgugccccacg

SEQ ID NO: 426 - RNA, 19 nt, Artificial Sequence
  Synthetic Target Sequence/siNA sense region
ggcaggccccugcaggaaa

SEQ ID NO: 427 - RNA, 19 nt, Artificial Sequence
  Synthetic Target Sequence/siNA sense region
aacugaggcccuugggcac

SEQ ID NO: 428 - RNA, 19 nt, Artificial Sequence
  Synthetic Target Sequence/siNA sense region
ccucgacuugugaacgagu

SEQ ID NO: 429 - RNA, 19 nt, Artificial Sequence
  Synthetic Target Sequence/siNA sense region
uuguuggcugcucccucca

SEQ ID NO: 430 - RNA, 19 nt, Artificial Sequence
  Synthetic Target Sequence/siNA sense region
acagcuucugcagcagacu

SEQ ID NO: 431 - RNA, 19 nt, Artificial Sequence
  Synthetic Target Sequence/siNA sense region
ugucccuguuguaacugcc

SEQ ID NO: 432 - RNA, 19 nt, Artificial Sequence
  Synthetic Target Sequence/siNA sense region
ccaaggcauguuuugccca

SEQ ID NO: 433 - RNA, 19 nt, Artificial Sequence
  Synthetic Target Sequence/siNA sense region
accagaucauggcccacgu

SEQ ID NO: 434 - RNA, 19 nt, Artificial Sequence
  Synthetic Target Sequence/siNA sense region
uggaggcccaccugccucu

SEQ ID NO: 435 - RNA, 19 nt, Artificial Sequence
  Synthetic Target Sequence/siNA sense region
ugucucacugaacuagaag

SEQ ID NO: 436 - RNA, 19 nt, Artificial Sequence
  Synthetic Target Sequence/siNA sense region
gccgagccuagaaacuaac

SEQ ID NO: 437 - RNA, 19 nt, Artificial Sequence
  Synthetic Target Sequence/siNA sense region
cacagccaucaagggaaug

SEQ ID NO: 438 - RNA, 19 nt, Artificial Sequence
  Synthetic Target Sequence/siNA sense region
gacuugggcggccuuggga

SEQ ID NO: 439 - RNA, 19 nt, Artificial Sequence
  Synthetic Target Sequence/siNA sense region
aaaucgaugagaaauugaa

SEQ ID NO: 440 - RNA, 19 nt, Artificial Sequence
  Synthetic Target Sequence/siNA sense region
acuucagggagggugguca

SEQ ID NO: 441 - RNA, 19 nt, Artificial Sequence
  Synthetic Target Sequence/siNA sense region
auugccuagaggugcucau

SEQ ID NO: 442 - RNA, 19 nt, Artificial Sequence
  Synthetic Target Sequence/siNA sense region
uucauuuaacagagcuucc

SEQ ID NO: 443 - RNA, 19 nt, Artificial Sequence
  Synthetic Target Sequence/siNA sense region
cuuagguugaugcuggagg

SEQ ID NO: 444 - RNA, 19 nt, Artificial Sequence
  Synthetic Target Sequence/siNA sense region
gcagaaucccggcugucaa

SEQ ID NO: 445 - RNA, 19 nt, Artificial Sequence
  Synthetic Target Sequence/siNA sense region
agggguguucaguuaaggg

SEQ ID NO: 446 - RNA, 19 nt, Artificial Sequence
  Synthetic Target Sequence/siNA sense region
ggagcaacagaggacauga

SEQ ID NO: 447 - RNA, 19 nt, Artificial Sequence
  Synthetic Target Sequence/siNA sense region
aaaaauugcuaugacuaaa

SEQ ID NO: 448 - RNA, 19 nt, Artificial Sequence
  Synthetic Target Sequence/siNA sense region
agcagggacaauuugcugc

SEQ ID NO: 449 - RNA, 19 nt, Artificial Sequence
  Synthetic Target Sequence/siNA sense region
ccaaacacccaugcccagc

SEQ ID NO: 450 - RNA, 19 nt, Artificial Sequence
  Synthetic Target Sequence/siNA sense region
cuguauggcugggggcucc

SEQ ID NO: 451 - RNA, 19 nt, Artificial Sequence
  Synthetic Target Sequence/siNA sense region
cucguaugcauggaacccc

SEQ ID NO: 452 - RNA, 19 nt, Artificial Sequence
  Synthetic Target Sequence/siNA sense region
ccagaauaaauaugcucag

SEQ ID NO: 453 - RNA, 19 nt, Artificial Sequence
  Synthetic Target Sequence/siNA sense region
gccacccugugggccgggc

SEQ ID NO: 454 - RNA, 19 nt, Artificial Sequence
  Synthetic Target Sequence/siNA sense region
caauccagacagcaggcau

SEQ ID NO: 455 - RNA, 19 nt, Artificial Sequence
  Synthetic Target Sequence/siNA sense region
uaaggcaccaguuacccug

SEQ ID NO: 456 - RNA, 19 nt, Artificial Sequence
  Synthetic Target Sequence/siNA sense region
gcauguuggcccagaccuc

SEQ ID NO: 457 - RNA, 19 nt, Artificial Sequence
  Synthetic Target Sequence/siNA sense region
caggugcuagggaaggcgg

SEQ ID NO: 458 - RNA, 19 nt, Artificial Sequence
  Synthetic Target Sequence/siNA sense region
ggaaccuuggguugaguaa

SEQ ID NO: 459 - RNA, 19 nt, Artificial Sequence
  Synthetic Target Sequence/siNA sense region
augcucgucuguguguuuu

SEQ ID NO: 460 - RNA, 19 nt, Artificial Sequence
  Synthetic Target Sequence/siNA sense region
uaguuucaucaccuguuau

SEQ ID NO: 461 - RNA, 19 nt, Artificial Sequence
  Synthetic Target Sequence/siNA sense region
ucuguguuugcugaggaga

SEQ ID NO: 462 - RNA, 19 nt, Artificial Sequence
  Synthetic Target Sequence/siNA sense region
aguggaacagaaggggugg

SEQ ID NO: 463 - RNA, 19 nt, Artificial Sequence
  Synthetic Target Sequence/siNA sense region
gaguuuuguauaaauaaag

SEQ ID NO: 464 - RNA, 19 nt, Artificial Sequence
  Synthetic Target Sequence/siNA sense region
uaaauaaaguuucuuuguc

SEQ ID NO: 465 - RNA, 19 nt, Artificial Sequence
  Synthetic siNA antisense region
cgcgccccugcuccauucg

SEQ ID NO: 466 - RNA, 19 nt, Artificial Sequence
  Synthetic siNA antisense region
uaaaucuuuaauuaucugc

SEQ ID NO: 467 - RNA, 19 nt, Artificial Sequence
  Synthetic siNA antisense region
auuucuuccagcugugugu

SEQ ID NO: 468 - RNA, 19 nt, Artificial Sequence
  Synthetic siNA antisense region
acgcccggcuucucuauga

SEQ ID NO: 469 - RNA, 19 nt, Artificial Sequence
  Synthetic siNA antisense region
uuauaggcaugagccacca

SEQ ID NO: 470 - RNA, 19 nt, Artificial Sequence
  Synthetic siNA antisense region
ccuccaaaagugcugggau

SEQ ID NO: 471 - RNA, 19 nt, Artificial Sequence
  Synthetic siNA antisense region
gugaucugcccgccucagc

SEQ ID NO: 472 - RNA, 19 nt, Artificial Sequence
  Synthetic siNA antisense region
ucgaacuccugaucucaag

SEQ ID NO: 473 - RNA, 19 nt, Artificial Sequence
  Synthetic siNA antisense region
caaggcaccaggcuggucu

SEQ ID NO: 474 - RNA, 19 nt, Artificial Sequence
  Synthetic siNA antisense region
caccccauugggagaugcc

SEQ ID NO: 475 - RNA, 19 nt, Artificial Sequence
  Synthetic siNA antisense region
aggagcccagagcaaagcc

SEQ ID NO: 476 - RNA, 19 nt, Artificial Sequence
  Synthetic siNA antisense region
aggcagcucacagggaaca

SEQ ID NO: 477 - RNA, 19 nt, Artificial Sequence
  Synthetic siNA antisense region
gccaccugcagcaggacca

SEQ ID NO: 478 - RNA, 19 nt, Artificial Sequence
  Synthetic siNA antisense region
uucauguucccagagcuug

SEQ ID NO: 479 - RNA, 19 nt, Artificial Sequence
  Synthetic siNA antisense region
gugggcuccugcaagaccu

SEQ ID NO: 480 - RNA, 19 nt, Artificial Sequence
  Synthetic siNA antisense region
auguagucggagacgcagg

SEQ ID NO: 481 - RNA, 19 nt, Artificial Sequence
  Synthetic siNA antisense region
ucgcaaguagagaugcuca

SEQ ID NO: 482 - RNA, 19 nt, Artificial Sequence
  Synthetic siNA antisense region
ggaccauucaucuuccacu

SEQ ID NO: 483 - RNA, 19 nt, Artificial Sequence
  Synthetic siNA antisense region
ucggugcugcaauuggugg

SEQ ID NO: 484 - RNA, 19 nt, Artificial Sequence
  Synthetic siNA antisense region
ugguacaacaggcggagcu

SEQ ID NO: 485 - RNA, 19 nt, Artificial Sequence
  Synthetic siNA antisense region
gagagcagaaaaaccagcu

SEQ ID NO: 486 - RNA, 19 nt, Artificial Sequence
  Synthetic siNA antisense region
auacacgugugggcuucgg

SEQ ID NO: 487 - RNA, 19 nt, Artificial Sequence
  Synthetic siNA antisense region
ccuccguuguucucaggga

SEQ ID NO: 488 - RNA, 19 nt, Artificial Sequence
  Synthetic siNA antisense region
uggcacacgcaccccgcgc

SEQ ID NO: 489 - RNA, 19 nt, Artificial Sequence
  Synthetic siNA antisense region
acgucauccaugagcaggu

SEQ ID NO: 490 - RNA, 19 nt, Artificial Sequence
  Synthetic siNA antisense region
uaguuauccgcacugacca

SEQ ID NO: 491 - RNA, 19 nt, Artificial Sequence
  Synthetic siNA antisense region
gcccacagguccaguguau

SEQ ID NO: 492 - RNA, 19 nt, Artificial Sequence
  Synthetic siNA antisense region
cacagcagcugcugcccag

SEQ ID NO: 493 - RNA, 19 nt, Artificial Sequence
  Synthetic siNA antisense region
ggcuugaaggagcccuucc

SEQ ID NO: 494 - RNA, 19 nt, Artificial Sequence
  Synthetic siNA antisense region
gguuucacaugcucgcugg

SEQ ID NO: 495 - RNA, 19 nt, Artificial Sequence
  Synthetic siNA antisense region
agguuuccuggggcccugg

SEQ ID NO: 496 - RNA, 19 nt, Artificial Sequence
  Synthetic siNA antisense region
acauuggugugaacuguca

SEQ ID NO: 497 - RNA, 19 nt, Artificial Sequence
  Synthetic siNA antisense region
agcagcagagugucggaga

SEQ ID NO: 498 - RNA, 19 nt, Artificial Sequence
  Synthetic siNA antisense region
uacggguugcuccagguca

SEQ ID NO: 499 - RNA, 19 nt, Artificial Sequence
  Synthetic siNA antisense region
agguaauugucagggggau

SEQ ID NO: 500 - RNA, 19 nt, Artificial Sequence
  Synthetic siNA antisense region
uaggugagaugauuauaca

SEQ ID NO: 501 - RNA, 19 nt, Artificial Sequence
  Synthetic siNA antisense region
cuccaaauguugacugcau

SEQ ID NO: 502 - RNA, 19 nt, Artificial Sequence
  Synthetic siNA antisense region
ucugccgggucguuuucac

SEQ ID NO: 503 - RNA, 19 nt, Artificial Sequence
  Synthetic siNA antisense region
acguuauagauucugaaau

SEQ ID NO: 504 - RNA, 19 nt, Artificial Sequence
  Synthetic siNA antisense region
gaggguucuagguagguca

SEQ ID NO: 505 - RNA, 19 nt, Artificial Sequence
  Synthetic siNA antisense region
cuggcugcgaugcggaggg

SEQ ID NO: 506 - RNA, 19 nt, Artificial Sequence
  Synthetic siNA antisense region
aucccagacuucagggugc

SEQ ID NO: 507 - RNA, 19 nt, Artificial Sequence
  Synthetic siNA antisense region
acccgugcccuguaggaaa

SEQ ID NO: 508 - RNA, 19 nt, Artificial Sequence
  Synthetic siNA antisense region
cacugagcccaggcccuca

SEQ ID NO: 509 - RNA, 19 nt, Artificial Sequence
  Synthetic siNA antisense region
cuccaggugguguuauagc

SEQ ID NO: 510 - RNA, 19 nt, Artificial Sequence
  Synthetic siNA antisense region
gugcuggggcuccacucac

SEQ ID NO: 511 - RNA, 19 nt, Artificial Sequence
  Synthetic siNA antisense region
uaggaguugugccacuugg

SEQ ID NO: 512 - RNA, 19 nt, Artificial Sequence
  Synthetic siNA antisense region
ugcucgaagggcucccugu

SEQ ID NO: 513 - RNA, 19 nt, Artificial Sequence
  Synthetic siNA antisense region
acgcccagcaggaggugcu

SEQ ID NO: 514 - RNA, 19 nt, Artificial Sequence
  Synthetic siNA antisense region
acaaugcaggaaacgcuga

SEQ ID NO: 515 - RNA, 19 nt, Artificial Sequence
  Synthetic siNA antisense region
aggcagacggccaggauga

SEQ ID NO: 516 - RNA, 19 nt, Artificial Sequence
  Synthetic siNA antisense region
augcugacauagcacaaca

SEQ ID NO: 517 - RNA, 19 nt, Artificial Sequence
  Synthetic siNA antisense region
ucuuucuuaaucuugguga

SEQ ID NO: 518 - RNA, 19 nt, Artificial Sequence
  Synthetic siNA antisense region
ggaaucugaucccaccauu

SEQ ID NO: 519 - RNA, 19 nt, Artificial Sequence
  Synthetic siNA antisense region
cggcugcgggcuggguugg

SEQ ID NO: 520 - RNA, 19 nt, Artificial Sequence
  Synthetic siNA antisense region
auuauuauagccacgaggc

SEQ ID NO: 521 - RNA, 19 nt, Artificial Sequence
  Synthetic siNA antisense region
gaccccugagcauccugga

SEQ ID NO: 522 - RNA, 19 nt, Artificial Sequence
  Synthetic siNA antisense region
gaccgcuucucccacugug

SEQ ID NO: 523 - RNA, 19 nt, Artificial Sequence
  Synthetic siNA antisense region
gcugguuccuggccucggg

SEQ ID NO: 524 - RNA, 19 nt, Artificial Sequence
  Synthetic siNA antisense region
uuccagugugggcacuugg

SEQ ID NO: 525 - RNA, 19 nt, Artificial Sequence
  Synthetic siNA antisense region
agcuugguaagacaauucu

SEQ ID NO: 526 - RNA, 19 nt, Artificial Sequence
  Synthetic siNA antisense region
uccagaaaacagggcaaga

SEQ ID NO: 527 - RNA, 19 nt, Artificial Sequence
  Synthetic siNA antisense region
ucccuuuucauguugugcu

SEQ ID NO: 528 - RNA, 19 nt, Artificial Sequence
  Synthetic siNA antisense region
gccuugugaggaucuucau

SEQ ID NO: 529 - RNA, 19 nt, Artificial Sequence
  Synthetic siNA antisense region
aaaggcaucucuuuggcag

SEQ ID NO: 530 - RNA, 19 nt, Artificial Sequence
  Synthetic siNA antisense region
gauuuuccagagcccugga

SEQ ID NO: 531 - RNA, 19 nt, Artificial Sequence
  Synthetic siNA antisense region
uccacugggcaccaugcug

SEQ ID NO: 532 - RNA, 19 nt, Artificial Sequence
  Synthetic siNA antisense region
aggacugucuugcugaucu

SEQ ID NO: 533 - RNA, 19 nt, Artificial Sequence
  Synthetic siNA antisense region
cugaugcucucuggccaga

SEQ ID NO: 534 - RNA, 19 nt, Artificial Sequence
  Synthetic siNA antisense region
uccacacaucgcaccacgc

SEQ ID NO: 535 - RNA, 19 nt, Artificial Sequence
  Synthetic siNA antisense region
accggggccucaaacaacu

SEQ ID NO: 536 - RNA, 19 nt, Artificial Sequence
  Synthetic siNA antisense region
uccuccuccucacacucca

SEQ ID NO: 537 - RNA, 19 nt, Artificial Sequence
  Synthetic siNA antisense region
uuuucuuccucuaccuccu

SEQ ID NO: 538 - RNA, 19 nt, Artificial Sequence
  Synthetic siNA antisense region
gaugcacagaagcucccuu

SEQ ID NO: 539 - RNA, 19 nt, Artificial Sequence
  Synthetic siNA antisense region
ucccugcugcucucaggcg

SEQ ID NO: 540 - RNA, 19 nt, Artificial Sequence
  Synthetic siNA antisense region
cuucccuccuggaagucau

SEQ ID NO: 541 - RNA, 19 nt, Artificial Sequence
  Synthetic siNA antisense region
cgggccacaaugcccuccc

SEQ ID NO: 542 - RNA, 19 nt, Artificial Sequence
  Synthetic siNA antisense region
aacaggcucucuguuagcc

SEQ ID NO: 543 - RNA, 19 nt, Artificial Sequence
  Synthetic siNA antisense region
ucuccgagcagguccagga

SEQ ID NO: 544 - RNA, 19 nt, Artificial Sequence
  Synthetic siNA antisense region
caaaagcccccauucuccu

SEQ ID NO: 545 - RNA, 19 nt, Artificial Sequence
  Synthetic siNA antisense region
ucccccauguccugcuggc

SEQ ID NO: 546 - RNA, 19 nt, Artificial Sequence
  Synthetic siNA antisense region
gguggaagaaggcaugacu

SEQ ID NO: 547 - RNA, 19 nt, Artificial Sequence
  Synthetic siNA antisense region
gcacucguacuucccgaag

SEQ ID NO: 548 - RNA, 19 nt, Artificial Sequence
  Synthetic siNA antisense region
ucaucccagggcaugugag

SEQ ID NO: 549 - RNA, 19 nt, Artificial Sequence
  Synthetic siNA antisense region
ggcccugcacuugggaacu

SEQ ID NO: 550 - RNA, 19 nt, Artificial Sequence
  Synthetic siNA antisense region
cagggaggugccuccuugg

SEQ ID NO: 551 - RNA, 19 nt, Artificial Sequence
  Synthetic siNA antisense region
agaggcugcuccuugcccc

SEQ ID NO: 552 - RNA, 19 nt, Artificial Sequence
  Synthetic siNA antisense region
ggacuuggcuccaggugga

SEQ ID NO: 553 - RNA, 19 nt, Artificial Sequence
  Synthetic siNA antisense region
ugggucgggcuggcaggag

SEQ ID NO: 554 - RNA, 19 nt, Artificial Sequence
  Synthetic siNA antisense region
gucagguugucuggacucu

SEQ ID NO: 555 - RNA, 19 nt, Artificial Sequence
  Synthetic siNA antisense region
aggggcgucucugugcaag

SEQ ID NO: 556 - RNA, 19 nt, Artificial Sequence
  Synthetic siNA antisense region
ggguugccugcgaugacga

SEQ ID NO: 557 - RNA, 19 nt, Artificial Sequence
  Synthetic siNA antisense region
cugaagcugcgguaagcag

SEQ ID NO: 558 - RNA, 19 nt, Artificial Sequence
  Synthetic siNA antisense region
gacuggcucagggaguugc

SEQ ID NO: 559 - RNA, 19 nt, Artificial Sequence
  Synthetic siNA antisense region
agcucucugggacacggug

SEQ ID NO: 560 - RNA, 19 nt, Artificial Sequence
  Synthetic siNA antisense region
agcagugggucuggaccca

SEQ ID NO: 561 - RNA, 19 nt, Artificial Sequence
  Synthetic siNA antisense region
uccuccaggugucuggcca

SEQ ID NO: 562 - RNA, 19 nt, Artificial Sequence
  Synthetic siNA antisense region
ggcaucucggguucuacuu

SEQ ID NO: 563 - RNA, 19 nt, Artificial Sequence
  Synthetic siNA antisense region
gagagcugggggacacagg

SEQ ID NO: 564 - RNA, 19 nt, Artificial Sequence
  Synthetic siNA antisense region
ggcacagugguuggcucag

SEQ ID NO: 565 - RNA, 19 nt, Artificial Sequence
  Synthetic siNA antisense region
guuucuggcucagguuggg

SEQ ID NO: 566 - RNA, 19 nt, Artificial Sequence
  Synthetic siNA antisense region
cggaggaucugcucccagg

SEQ ID NO: 567 - RNA, 19 nt, Artificial Sequence
  Synthetic siNA antisense region
ugcuggaggacauuucggc

SEQ ID NO: 568 - RNA, 19 nt, Artificial Sequence
  Synthetic siNA antisense region
ggggcugcagcugccccau

SEQ ID NO: 569 - RNA, 19 nt, Artificial Sequence
  Synthetic siNA antisense region
cuggugggggccgagacgg

SEQ ID NO: 570 - RNA, 19 nt, Artificial Sequence
  Synthetic siNA antisense region
acaaacuccugauagccac

SEQ ID NO: 571 - RNA, 19 nt, Artificial Sequence
  Synthetic siNA antisense region
cccugcuccaccgcaugua

SEQ ID NO: 572 - RNA, 19 nt, Artificial Sequence
  Synthetic siNA antisense region
gcacuggccugggugccac

SEQ ID NO: 573 - RNA, 19 nt, Artificial Sequence
  Synthetic siNA antisense region
ggacccaagcccaccaccg

SEQ ID NO: 574 - RNA, 19 nt, Artificial Sequence
  Synthetic siNA antisense region
uaaccagccucuccugggg

SEQ ID NO: 575 - RNA, 19 nt, Artificial Sequence
  Synthetic siNA antisense region
aggcuugagaaggccuugu

SEQ ID NO: 576 - RNA, 19 nt, Artificial Sequence
  Synthetic siNA antisense region
acagcacugcuggcaagca

SEQ ID NO: 577 - RNA, 19 nt, Artificial Sequence
  Synthetic siNA antisense region
ccacauuucucuggggaca

SEQ ID NO: 578 - RNA, 19 nt, Artificial Sequence
  Synthetic siNA antisense region
ccacugcuagccccaaacc

SEQ ID NO: 579 - RNA, 19 nt, Artificial Sequence
  Synthetic siNA antisense region
ggcuuauaccccucuuccc

SEQ ID NO: 580 - RNA, 19 nt, Artificial Sequence
  Synthetic siNA antisense region
ggaaugaggucuuggaaag

SEQ ID NO: 581 - RNA, 19 nt, Artificial Sequence
  Synthetic siNA antisense region
ggguccccagggcagccag

SEQ ID NO: 582 - RNA, 19 nt, Artificial Sequence
  Synthetic siNA antisense region
gggacagggacuggggcag

SEQ ID NO: 583 - RNA, 19 nt, Artificial Sequence
  Synthetic siNA antisense region
aguccaaaggugaacaagg

SEQ ID NO: 584 - RNA, 19 nt, Artificial Sequence
  Synthetic siNA antisense region
cgagguggcucccugucca

SEQ ID NO: 585 - RNA, 19 nt, Artificial Sequence
  Synthetic siNA antisense region
ugugagcucugcggacugc

SEQ ID NO: 586 - RNA, 19 nt, Artificial Sequence
  Synthetic siNA antisense region
ggggagcugcuugggagau

SEQ ID NO: 587 - RNA, 19 nt, Artificial Sequence
  Synthetic siNA antisense region
uccagacccaggugcucug

SEQ ID NO: 588 - RNA, 19 nt, Artificial Sequence
  Synthetic siNA antisense region
ucuaccuuuucccccggcu

SEQ ID NO: 589 - RNA, 19 nt, Artificial Sequence
  Synthetic siNA antisense region
gggggcuuuggcauguccu

SEQ ID NO: 590 - RNA, 19 nt, Artificial Sequence
  Synthetic siNA antisense region
gccugcuccuggggaagug

SEQ ID NO: 591 - RNA, 19 nt, Artificial Sequence
  Synthetic siNA antisense region
uccacaagggggucugugg

SEQ ID NO: 592 - RNA, 19 nt, Artificial Sequence
  Synthetic siNA antisense region
augccacugcccaggcugu

SEQ ID NO: 593 - RNA, 19 nt, Artificial Sequence
  Synthetic siNA antisense region
guaagggcugaguagacaa

SEQ ID NO: 594 - RNA, 19 nt, Artificial Sequence
  Synthetic siNA antisense region
uggccgcacagguggcagg

SEQ ID NO: 595 - RNA, 19 nt, Artificial Sequence
  Synthetic siNA antisense region
ccaugacacuguuucaggu

SEQ ID NO: 596 - RNA, 19 nt, Artificial Sequence
  Synthetic siNA antisense region
uggccaccauccuccuggc

SEQ ID NO: 597 - RNA, 19 nt, Artificial Sequence
  Synthetic siNA antisense region
cuggccaugacaggggucu

SEQ ID NO: 598 - RNA, 19 nt, Artificial Sequence
  Synthetic siNA antisense region
cagcagccacagcaaggac

SEQ ID NO: 599 - RNA, 19 nt, Artificial Sequence
  Synthetic siNA antisense region
gaggaccugucuccacagc

SEQ ID NO: 600 - RNA, 19 nt, Artificial Sequence
  Synthetic siNA antisense region
agggggguuguagggggcg

SEQ ID NO: 601 - RNA, 19 nt, Artificial Sequence
  Synthetic siNA antisense region
gaggggucuggggcccuca

SEQ ID NO: 602 - RNA, 19 nt, Artificial Sequence
  Synthetic siNA antisense region
aguggaaccccaccuggag

SEQ ID NO: 603 - RNA, 19 nt, Artificial Sequence
  Synthetic siNA antisense region
ggacacagacuggccucca

SEQ ID NO: 604 - RNA, 19 nt, Artificial Sequence
  Synthetic siNA antisense region
gagggugccagggaggccg

SEQ ID NO: 605 - RNA, 19 nt, Artificial Sequence
  Synthetic siNA antisense region
cucuucucugagaugcccg

SEQ ID NO: 606 - RNA, 19 nt, Artificial Sequence
  Synthetic siNA antisense region
aaggaugaugaggauuuac

SEQ ID NO: 607 - RNA, 19 nt, Artificial Sequence
  Synthetic siNA antisense region
uugccaggggcaggaugga

SEQ ID NO: 608 - RNA, 19 nt, Artificial Sequence
  Synthetic siNA antisense region
uggcuugagcucugagcau

SEQ ID NO: 609 - RNA, 19 nt, Artificial Sequence
  Synthetic siNA antisense region
uucacgauuuugggggucu

SEQ ID NO: 610 - RNA, 19 nt, Artificial Sequence
  Synthetic siNA antisense region
ggucccacggagacaaagu

SEQ ID NO: 611 - RNA, 19 nt, Artificial Sequence
  Synthetic siNA antisense region
gagacccucauguaugugg

SEQ ID NO: 612 - RNA, 19 nt, Artificial Sequence
  Synthetic siNA antisense region
aagaggacaugcaccuaag

SEQ ID NO: 613 - RNA, 19 nt, Artificial Sequence
  Synthetic siNA antisense region
aucugcagacucagcaaca

SEQ ID NO: 614 - RNA, 19 nt, Artificial Sequence
  Synthetic siNA antisense region
ggauaagcccuaguccuca

SEQ ID NO: 615 - RNA, 19 nt, Artificial Sequence
  Synthetic siNA antisense region
guggcauuucccaggcaug

SEQ ID NO: 616 - RNA, 19 nt, Artificial Sequence
  Synthetic siNA antisense region
cuggcugccuuccaggagg

SEQ ID NO: 617 - RNA, 19 nt, Artificial Sequence
  Synthetic siNA antisense region
uuuuggaaaucugccagcc

SEQ ID NO: 618 - RNA, 19 nt, Artificial Sequence
  Synthetic siNA antisense region
accaugguucuucaagucu

SEQ ID NO: 619 - RNA, 19 nt, Artificial Sequence
  Synthetic siNA antisense region
ggggccaaucaccuucaua

SEQ ID NO: 620 - RNA, 19 nt, Artificial Sequence
  Synthetic siNA antisense region
uguuaggccaacgucagug

SEQ ID NO: 621 - RNA, 19 nt, Artificial Sequence
  Synthetic siNA antisense region
ccagucucugcagcccagu

SEQ ID NO: 622 - RNA, 19 nt, Artificial Sequence
  Synthetic siNA antisense region
cccaaugcugggcgggguc

SEQ ID NO: 623 - RNA, 19 nt, Artificial Sequence
  Synthetic siNA antisense region
gggauguggcgagcccagc

SEQ ID NO: 624 - RNA, 19 nt, Artificial Sequence
  Synthetic siNA antisense region
agugcccucuacucucaug

SEQ ID NO: 625 - RNA, 19 nt, Artificial Sequence
  Synthetic siNA antisense region
cguggggcacggcgaccca

SEQ ID NO: 626 - RNA, 19 nt, Artificial Sequence
  Synthetic siNA antisense region
uuuccugcaggggccugcc

SEQ ID NO: 627 - RNA, 19 nt, Artificial Sequence
  Synthetic siNA antisense region
gugcccaagggccucaguu

SEQ ID NO: 628 - RNA, 19 nt, Artificial Sequence
  Synthetic siNA antisense region
acucguucacaagucgagg

SEQ ID NO: 629 - RNA, 19 nt, Artificial Sequence
  Synthetic siNA antisense region
uggagggagcagccaacaa

SEQ ID NO: 630 - RNA, 19 nt, Artificial Sequence
  Synthetic siNA antisense region
agucugcugcagaagcugu

SEQ ID NO: 631 - RNA, 19 nt, Artificial Sequence
  Synthetic siNA antisense region
ggcaguuacaacagggaca

SEQ ID NO: 632 - RNA, 19 nt, Artificial Sequence
  Synthetic siNA antisense region
ugggcaaaacaugccuugg

SEQ ID NO: 633 - RNA, 19 nt, Artificial Sequence
  Synthetic siNA antisense region
acgugggccaugaucuggu

SEQ ID NO: 634 - RNA, 19 nt, Artificial Sequence
  Synthetic siNA antisense region
agaggcaggugggccucca

SEQ ID NO: 635 - RNA, 19 nt, Artificial Sequence
  Synthetic siNA antisense region
cuucuaguucagugagaca

SEQ ID NO: 636 - RNA, 19 nt, Artificial Sequence
  Synthetic siNA antisense region
guuaguuucuaggcucggc

SEQ ID NO: 637 - RNA, 19 nt, Artificial Sequence
  Synthetic siNA antisense region
cauucccuugauggcugug

SEQ ID NO: 638 - RNA, 19 nt, Artificial Sequence
  Synthetic siNA antisense region
ucccaaggccgcccaaguc

SEQ ID NO: 639 - RNA, 19 nt, Artificial Sequence
  Synthetic siNA antisense region
uucaauuucucaucgauuu

SEQ ID NO: 640 - RNA, 19 nt, Artificial Sequence
  Synthetic siNA antisense region
ugaccacccucccugaagu

SEQ ID NO: 641 - RNA, 19 nt, Artificial Sequence
  Synthetic siNA antisense region
augagcaccucuaggcaau

SEQ ID NO: 642 - RNA, 19 nt, Artificial Sequence
  Synthetic siNA antisense region
ggaagcucuguuaaaugaa

SEQ ID NO: 643 - RNA, 19 nt, Artificial Sequence
  Synthetic siNA antisense region
ccuccagcaucaaccuaag

SEQ ID NO: 644 - RNA, 19 nt, Artificial Sequence
  Synthetic siNA antisense region
uugacagccgggauucugc

SEQ ID NO: 645 - RNA, 19 nt, Artificial Sequence
  Synthetic siNA antisense region
cccuuaacugaacaccccu

SEQ ID NO: 646 - RNA, 19 nt, Artificial Sequence
  Synthetic siNA antisense region
ucauguccucuguugcucc

SEQ ID NO: 647 - RNA, 19 nt, Artificial Sequence
  Synthetic siNA antisense region
uuuagucauagcaauuuuu

SEQ ID NO: 648 - RNA, 19 nt, Artificial Sequence
  Synthetic siNA antisense region
gcagcaaauugucccugcu

SEQ ID NO: 649 - RNA, 19 nt, Artificial Sequence
  Synthetic siNA antisense region
gcugggcauggguguuugg

SEQ ID NO: 650 - RNA, 19 nt, Artificial Sequence
  Synthetic siNA antisense region
ggagcccccagccauacag

SEQ ID NO: 651 - RNA, 19 nt, Artificial Sequence
  Synthetic siNA antisense region
gggguuccaugcauacgag

SEQ ID NO: 652 - RNA, 19 nt, Artificial Sequence
  Synthetic siNA antisense region
cugagcauauuuauucugg

SEQ ID NO: 653 - RNA, 19 nt, Artificial Sequence
  Synthetic siNA antisense region
gcccggcccacaggguggc

SEQ ID NO: 654 - RNA, 19 nt, Artificial Sequence
  Synthetic siNA antisense region
augccugcugucuggauug

SEQ ID NO: 655 - RNA, 19 nt, Artificial Sequence
  Synthetic siNA antisense region
caggguaacuggugccuua

SEQ ID NO: 656 - RNA, 19 nt, Artificial Sequence
  Synthetic siNA antisense region
gaggucugggccaacaugc

SEQ ID NO: 657 - RNA, 19 nt, Artificial Sequence
  Synthetic siNA antisense region
ccgccuucccuagcaccug

SEQ ID NO: 658 - RNA, 19 nt, Artificial Sequence
  Synthetic siNA antisense region
uuacucaacccaagguucc

SEQ ID NO: 659 - RNA, 19 nt, Artificial Sequence
  Synthetic siNA antisense region
aaaacacacagacgagcau

SEQ ID NO: 660 - RNA, 19 nt, Artificial Sequence
  Synthetic siNA antisense region
auaacaggugaugaaacua

SEQ ID NO: 661 - RNA, 19 nt, Artificial Sequence
  Synthetic siNA antisense region
ucuccucagcaaacacaga

SEQ ID NO: 662 - RNA, 19 nt, Artificial Sequence
  Synthetic siNA antisense region
ccaccccuucuguuccacu

SEQ ID NO: 663 - RNA, 19 nt, Artificial Sequence
  Synthetic siNA antisense region
cuuuauuuauacaaaacuc

SEQ ID NO: 664 - RNA, 19 nt, Artificial Sequence
  Synthetic siNA antisense region
gacaaagaaacuuuauuua

SEQ ID NO: 665 - RNA, 19 nt, Artificial Sequence
  Synthetic Target Sequence/siNA sense region
gccacccagccuaugcauc

SEQ ID NO: 666 - RNA, 19 nt, Artificial Sequence
  Synthetic Target Sequence/siNA sense region
ccgcuccucaauccucucc

SEQ ID NO: 667 - RNA, 19 nt, Artificial Sequence
  Synthetic Target Sequence/siNA sense region
cuguuggcacugggccuca

SEQ ID NO: 668 - RNA, 19 nt, Artificial Sequence
  Synthetic Target Sequence/siNA sense region
auggcgcuuuuguugacca

SEQ ID NO: 669 - RNA, 19 nt, Artificial Sequence
  Synthetic Target Sequence/siNA sense region
acggucauugcucucacuu

SEQ ID NO: 670 - RNA, 19 nt, Artificial Sequence
  Synthetic Target Sequence/siNA sense region
ugccuuggcggcuuugccu

SEQ ID NO: 671 - RNA, 19 nt, Artificial Sequence
  Synthetic Target Sequence/siNA sense region
uccccaggcccugugccuc

SEQ ID NO: 672 - RNA, 19 nt, Artificial Sequence
  Synthetic Target Sequence/siNA sense region
cccucuacagcccucaggg

SEQ ID NO: 673 - RNA, 19 nt, Artificial Sequence
  Synthetic Target Sequence/siNA sense region
gagcucauugaggagcugg

SEQ ID NO: 674 - RNA, 19 nt, Artificial Sequence
  Synthetic Target Sequence/siNA sense region
gucaacaucacccagaacc

SEQ ID NO: 675 - RNA, 19 nt, Artificial Sequence
  Synthetic Target Sequence/siNA sense region
cagaaggcuccgcucugca

SEQ ID NO: 676 - RNA, 19 nt, Artificial Sequence
  Synthetic Target Sequence/siNA sense region
aauggcagcaugguaugga

SEQ ID NO: 677 - RNA, 19 nt, Artificial Sequence
  Synthetic Target Sequence/siNA sense region
agcaucaaccugacagcug

SEQ ID NO: 678 - RNA, 19 nt, Artificial Sequence
  Synthetic Target Sequence/siNA sense region
ggcauguacugugcagccc

SEQ ID NO: 679 - RNA, 19 nt, Artificial Sequence
  Synthetic Target Sequence/siNA sense region
cuggaaucccugaucaacg

SEQ ID NO: 680 - RNA, 19 nt, Artificial Sequence
  Synthetic Target Sequence/siNA sense region
gugucaggcugcagugcca

SEQ ID NO: 681 - RNA, 19 nt, Artificial Sequence
  Synthetic Target Sequence/siNA sense region
aucgagaagacccagagga

SEQ ID NO: 682 - RNA, 19 nt, Artificial Sequence
  Synthetic Target Sequence/siNA sense region
augcugagcggauucugcc

SEQ ID NO: 683 - RNA, 19 nt, Artificial Sequence
  Synthetic Target Sequence/siNA sense region
ccgcacaaggucucagcug

SEQ ID NO: 684 - RNA, 19 nt, Artificial Sequence
  Synthetic Target Sequence/siNA sense region
gggcaguuuuccagcuugc

SEQ ID NO: 685 - RNA, 19 nt, Artificial Sequence
  Synthetic Target Sequence/siNA sense region
cauguccgagacaccaaaa

SEQ ID NO: 686 - RNA, 19 nt, Artificial Sequence
  Synthetic Target Sequence/siNA sense region
aucgagguggcccaguuug

SEQ ID NO: 687 - RNA, 19 nt, Artificial Sequence
  Synthetic Target Sequence/siNA sense region
guaaaggaccugcucuuac

SEQ ID NO: 688 - RNA, 19 nt, Artificial Sequence
  Synthetic Target Sequence/siNA sense region
cauuuaaagaaacuuuuuc

SEQ ID NO: 689 - RNA, 19 nt, Artificial Sequence
  Synthetic Target Sequence/siNA sense region
cgcgagggacaguucaacu

SEQ ID NO: 690 - RNA, 19 nt, Artificial Sequence
  Synthetic Target Sequence/siNA sense region
ugaaacuucgaaagcauca

SEQ ID NO: 691 - RNA, 19 nt, Artificial Sequence
  Synthetic Target Sequence/siNA sense region
auuauuugcagagacagga

SEQ ID NO: 692 - RNA, 19 nt, Artificial Sequence
  Synthetic Target Sequence/siNA sense region
accugacuauugaaguugc

SEQ ID NO: 693 - RNA, 19 nt, Artificial Sequence
  Synthetic Target Sequence/siNA sense region
cagauucauuuuucuuucu

SEQ ID NO: 694 - RNA, 19 nt, Artificial Sequence
  Synthetic Target Sequence/siNA sense region
ugaugucaaaaaugucuug

SEQ ID NO: 695 - RNA, 19 nt, Artificial Sequence
  Synthetic Target Sequence/siNA sense region
ggguaggcgggaaggaggg

SEQ ID NO: 696 - RNA, 19 nt, Artificial Sequence
  Synthetic Target Sequence/siNA sense region
guuagggagggguaaaauu

SEQ ID NO: 697 - RNA, 19 nt, Artificial Sequence
  Synthetic Target Sequence/siNA sense region
uccuuagcuuagaccucag

SEQ ID NO: 698 - RNA, 19 nt, Artificial Sequence
  Synthetic Target Sequence/siNA sense region
gccugugcugcccgucuuc

SEQ ID NO: 699 - RNA, 19 nt, Artificial Sequence
  Synthetic Target Sequence/siNA sense region
cagccuagccgaccucagc

SEQ ID NO: 700 - RNA, 19 nt, Artificial Sequence
  Synthetic Target Sequence/siNA sense region
ccuuccccuugcccagggc

SEQ ID NO: 701 - RNA, 19 nt, Artificial Sequence
  Synthetic Target Sequence/siNA sense region
cucagccuggugggccucc

SEQ ID NO: 702 - RNA, 19 nt, Artificial Sequence
  Synthetic Target Sequence/siNA sense region
cucuguccagggcccugag

SEQ ID NO: 703 - RNA, 19 nt, Artificial Sequence
  Synthetic Target Sequence/siNA sense region
gcucgguggacccagggau

SEQ ID NO: 704 - RNA, 19 nt, Artificial Sequence
  Synthetic Target Sequence/siNA sense region
ugacaugucccuacacccc

SEQ ID NO: 705 - RNA, 19 nt, Artificial Sequence
  Synthetic Target Sequence/siNA sense region
cuccccugcccuagagcac

SEQ ID NO: 706 - RNA, 19 nt, Artificial Sequence
  Synthetic Target Sequence/siNA sense region
cacuguagcauuacagugg

SEQ ID NO: 707 - RNA, 19 nt, Artificial Sequence
  Synthetic Target Sequence/siNA sense region
ggugccccccuugccagac

SEQ ID NO: 708 - RNA, 19 nt, Artificial Sequence
  Synthetic Target Sequence/siNA sense region
cauguggugggacagggac

SEQ ID NO: 709 - RNA, 19 nt, Artificial Sequence
  Synthetic Target Sequence/siNA sense region
cccacuucacacacaggca

SEQ ID NO: 710 - RNA, 19 nt, Artificial Sequence
  Synthetic Target Sequence/siNA sense region
aacugaggcagacagcagc

SEQ ID NO: 711 - RNA, 19 nt, Artificial Sequence
  Synthetic Target Sequence/siNA sense region
cucaggcacacuucuucuu

SEQ ID NO: 712 - RNA, 19 nt, Artificial Sequence
  Synthetic Target Sequence/siNA sense region
uggucuuauuuauuauugu

SEQ ID NO: 713 - RNA, 19 nt, Artificial Sequence
  Synthetic Target Sequence/siNA sense region
uguguuauuuaaaugagug

SEQ ID NO: 714 - RNA, 19 nt, Artificial Sequence
  Synthetic Target Sequence/siNA sense region
guguuugucaccguugggg

SEQ ID NO: 715 - RNA, 19 nt, Artificial Sequence
  Synthetic Target Sequence/siNA sense region
gauuggggaagacuguggc

SEQ ID NO: 716 - RNA, 19 nt, Artificial Sequence
  Synthetic Target Sequence/siNA sense region
cugcuagcacuuggagcca

SEQ ID NO: 717 - RNA, 19 nt, Artificial Sequence
  Synthetic Target Sequence/siNA sense region
aaggguucagagacucagg

SEQ ID NO: 718 - RNA, 19 nt, Artificial Sequence
  Synthetic Target Sequence/siNA sense region
ggccccagcacuaaagcag

SEQ ID NO: 719 - RNA, 19 nt, Artificial Sequence
  Synthetic Target Sequence/siNA sense region
guggacaccaggagucccu

SEQ ID NO: 720 - RNA, 19 nt, Artificial Sequence
  Synthetic Target Sequence/siNA sense region
ugguaauaaguacugugua

SEQ ID NO: 721 - RNA, 19 nt, Artificial Sequence
  Synthetic Target Sequence/siNA sense region
acagaauucugcuaccuca

SEQ ID NO: 722 - RNA, 19 nt, Artificial Sequence
  Synthetic Target Sequence/siNA sense region
acugggguccuggggccuc

SEQ ID NO: 723 - RNA, 19 nt, Artificial Sequence
  Synthetic Target Sequence/siNA sense region
cggagccucauccgaggca

SEQ ID NO: 724 - RNA, 19 nt, Artificial Sequence
  Synthetic Target Sequence/siNA sense region
agggucaggagaggggcag

SEQ ID NO: 725 - RNA, 19 nt, Artificial Sequence
  Synthetic Target Sequence/siNA sense region
gaacagccgcuccugucug

SEQ ID NO: 726 - RNA, 19 nt, Artificial Sequence
  Synthetic Target Sequence/siNA sense region
gccagccagcagccagcuc

SEQ ID NO: 727 - RNA, 19 nt, Artificial Sequence
  Synthetic Target Sequence/siNA sense region
cucagccaacgaguaauuu

SEQ ID NO: 728 - RNA, 19 nt, Artificial Sequence
  Synthetic Target Sequence/siNA sense region
uauuguuuuuccuuguauu

SEQ ID NO: 729 - RNA, 19 nt, Artificial Sequence
  Synthetic Target Sequence/siNA sense region
uuaaauauuaaauauguua

SEQ ID NO: 730 - RNA, 19 nt, Artificial Sequence
  Synthetic Target Sequence/siNA sense region
agcaaagaguuaauauaua

SEQ ID NO: 731 - RNA, 19 nt, Artificial Sequence
  Synthetic Target Sequence/siNA sense region
agaaggguaccuugaacac

SEQ ID NO: 732 - RNA, 19 nt, Artificial Sequence
  Synthetic Target Sequence/siNA sense region
cugggggaggggacauuga

SEQ ID NO: 733 - RNA, 19 nt, Artificial Sequence
  Synthetic Target Sequence/siNA sense region
aacaaguuguuucauugac

SEQ ID NO: 734 - RNA, 19 nt, Artificial Sequence
  Synthetic Target Sequence/siNA sense region
cuaucaaacugaagccaga

SEQ ID NO: 735 - RNA, 19 nt, Artificial Sequence
  Synthetic Target Sequence/siNA sense region
gaaauaaaguuggugacag

SEQ ID NO: 736 - RNA, 19 nt, Artificial Sequence
  Synthetic siNA antisense region
gaugcauaggcuggguggc

SEQ ID NO: 737 - RNA, 19 nt, Artificial Sequence
  Synthetic siNA antisense region
ggagaggauugaggagcgg

SEQ ID NO: 738 - RNA, 19 nt, Artificial Sequence
  Synthetic siNA antisense region
ugaggcccagugccaacag

SEQ ID NO: 739 - RNA, 19 nt, Artificial Sequence
  Synthetic siNA antisense region
uggucaacaaaagcgccau

SEQ ID NO: 740 - RNA, 19 nt, Artificial Sequence
  Synthetic siNA antisense region
aagugagagcaaugaccgu

SEQ ID NO: 741 - RNA, 19 nt, Artificial Sequence
  Synthetic siNA antisense region
aggcaaagccgccaaggca

SEQ ID NO: 742 - RNA, 19 nt, Artificial Sequence
  Synthetic siNA antisense region
gaggcacagggccugggga

SEQ ID NO: 743 - RNA, 19 nt, Artificial Sequence
  Synthetic siNA antisense region
cccugagggcuguagaggg

SEQ ID NO: 744 - RNA, 19 nt, Artificial Sequence
  Synthetic siNA antisense region
ccagcuccucaaugagcuc

SEQ ID NO: 745 - RNA, 19 nt, Artificial Sequence
  Synthetic siNA antisense region
gguucugggugauguugac

SEQ ID NO: 746 - RNA, 19 nt, Artificial Sequence
  Synthetic siNA antisense region
ugcagagcggagccuucug

SEQ ID NO: 747 - RNA, 19 nt, Artificial Sequence
  Synthetic siNA antisense region
uccauaccaugcugccauu

SEQ ID NO: 748 - RNA, 19 nt, Artificial Sequence
  Synthetic siNA antisense region
cagcugucagguugaugcu

SEQ ID NO: 749 - RNA, 19 nt, Artificial Sequence
  Synthetic siNA antisense region
gggcugcacaguacaugcc

SEQ ID NO: 750 - RNA, 19 nt, Artificial Sequence
  Synthetic siNA antisense region
cguugaucagggauuccag

SEQ ID NO: 751 - RNA, 19 nt, Artificial Sequence
  Synthetic siNA antisense region
uggcacugcagccugacac

SEQ ID NO: 752 - RNA, 19 nt, Artificial Sequence
  Synthetic siNA antisense region
uccucugggucuucucgau

SEQ ID NO: 753 - RNA, 19 nt, Artificial Sequence
  Synthetic siNA antisense region
ggcagaauccgcucagcau

SEQ ID NO: 754 - RNA, 19 nt, Artificial Sequence
  Synthetic siNA antisense region
cagcugagaccuugugcgg

SEQ ID NO: 755 - RNA, 19 nt, Artificial Sequence
  Synthetic siNA antisense region
gcaagcuggaaaacugccc

SEQ ID NO: 756 - RNA, 19 nt, Artificial Sequence
  Synthetic siNA antisense region
uuuuggugucucggacaug

SEQ ID NO: 757 - RNA, 19 nt, Artificial Sequence
  Synthetic siNA antisense region
caaacugggccaccucgau

SEQ ID NO: 758 - RNA, 19 nt, Artificial Sequence
  Synthetic siNA antisense region
guaagagcagguccuuuac

SEQ ID NO: 759 - RNA, 19 nt, Artificial Sequence
  Synthetic siNA antisense region
gaaaaaguuucuuuaaaug

SEQ ID NO: 760 - RNA, 19 nt, Artificial Sequence
  Synthetic siNA antisense region
aguugaacugucccucgcg

SEQ ID NO: 761 - RNA, 19 nt, Artificial Sequence
  Synthetic siNA antisense region
ugaugcuuucgaaguuuca

SEQ ID NO: 762 - RNA, 19 nt, Artificial Sequence
  Synthetic siNA antisense region
uccugucucugcaaauaau

SEQ ID NO: 763 - RNA, 19 nt, Artificial Sequence
  Synthetic siNA antisense region
gcaacuucaauagucaggu

SEQ ID NO: 764 - RNA, 19 nt, Artificial Sequence
  Synthetic siNA antisense region
agaaagaaaaaugaaucug

SEQ ID NO: 765 - RNA, 19 nt, Artificial Sequence
  Synthetic siNA antisense region
caagacauuuuugacauca

SEQ ID NO: 766 - RNA, 19 nt, Artificial Sequence
  Synthetic siNA antisense region
cccuccuucccgccuaccc

SEQ ID NO: 767 - RNA, 19 nt, Artificial Sequence
  Synthetic siNA antisense region
aauuuuaccccucccuaac

SEQ ID NO: 768 - RNA, 19 nt, Artificial Sequence
  Synthetic siNA antisense region
cugaggucuaagcuaagga

SEQ ID NO: 769 - RNA, 19 nt, Artificial Sequence
  Synthetic siNA antisense region
gaagacgggcagcacaggc

SEQ ID NO: 770 - RNA, 19 nt, Artificial Sequence
  Synthetic siNA antisense region
gcugaggucggcuaggcug

SEQ ID NO: 771 - RNA, 19 nt, Artificial Sequence
  Synthetic siNA antisense region
gcccugggcaaggggaagg

SEQ ID NO: 772 - RNA, 19 nt, Artificial Sequence
  Synthetic siNA antisense region
ggaggcccaccaggcugag

SEQ ID NO: 773 - RNA, 19 nt, Artificial Sequence
  Synthetic siNA antisense region
cucagggcccuggacagag

SEQ ID NO: 774 - RNA, 19 nt, Artificial Sequence
  Synthetic siNA antisense region
aucccuggguccaccgagc

SEQ ID NO: 775 - RNA, 19 nt, Artificial Sequence
  Synthetic siNA antisense region
gggguguagggacauguca

SEQ ID NO: 776 - RNA, 19 nt, Artificial Sequence
  Synthetic siNA antisense region
gugcucuagggcaggggag

SEQ ID NO: 777 - RNA, 19 nt, Artificial Sequence
  Synthetic siNA antisense region
ccacuguaaugcuacagug

SEQ ID NO: 778 - RNA, 19 nt, Artificial Sequence
  Synthetic siNA antisense region
gucuggcaaggggggcacc

SEQ ID NO: 779 - RNA, 19 nt, Artificial Sequence
  Synthetic siNA antisense region
gucccugucccaccacaug

SEQ ID NO: 780 - RNA, 19 nt, Artificial Sequence
  Synthetic siNA antisense region
ugccugugugugaaguggg

SEQ ID NO: 781 - RNA, 19 nt, Artificial Sequence
  Synthetic siNA antisense region
gcugcugucugccucaguu

SEQ ID NO: 782 - RNA, 19 nt, Artificial Sequence
  Synthetic siNA antisense region
aagaagaagugugccugag

SEQ ID NO: 783 - RNA, 19 nt, Artificial Sequence
  Synthetic siNA antisense region
acaauaauaaauaagacca

SEQ ID NO: 784 - RNA, 19 nt, Artificial Sequence
  Synthetic siNA antisense region
cacucauuuaaauaacaca

SEQ ID NO: 785 - RNA, 19 nt, Artificial Sequence
  Synthetic siNA antisense region
ccccaacggugacaaacac

SEQ ID NO: 786 - RNA, 19 nt, Artificial Sequence
  Synthetic siNA antisense region
gccacagucuuccccaauc

SEQ ID NO: 787 - RNA, 19 nt, Artificial Sequence
  Synthetic siNA antisense region
uggcuccaagugcuagcag

SEQ ID NO: 788 - RNA, 19 nt, Artificial Sequence
  Synthetic siNA antisense region
ccugagucucugaacccuu

SEQ ID NO: 789 - RNA, 19 nt, Artificial Sequence
  Synthetic siNA antisense region
cugcuuuagugcuggggcc

SEQ ID NO: 790 - RNA, 19 nt, Artificial Sequence
  Synthetic siNA antisense region
agggacuccugguguccac

SEQ ID NO: 791 - RNA, 19 nt, Artificial Sequence
  Synthetic siNA antisense region
uacacaguacuuauuacca

SEQ ID NO: 792 - RNA, 19 nt, Artificial Sequence
  Synthetic siNA antisense region
ugagguagcagaauucugu

SEQ ID NO: 793 - RNA, 19 nt, Artificial Sequence
  Synthetic siNA antisense region
gaggccccaggaccccagu

SEQ ID NO: 794 - RNA, 19 nt, Artificial Sequence
  Synthetic siNA antisense region
ugccucggaugaggcuccg

SEQ ID NO: 795 - RNA, 19 nt, Artificial Sequence
  Synthetic siNA antisense region
cugccccucuccugacccu

SEQ ID NO: 796 - RNA, 19 nt, Artificial Sequence
  Synthetic siNA antisense region
cagacaggagcggcuguuc

SEQ ID NO: 797 - RNA, 19 nt, Artificial Sequence
  Synthetic siNA antisense region
gagcuggcugcuggcuggc

SEQ ID NO: 798 - RNA, 19 nt, Artificial Sequence
  Synthetic siNA antisense region
aaauuacucguuggcugag

SEQ ID NO: 799 - RNA, 19 nt, Artificial Sequence
  Synthetic siNA antisense region
aauacaaggaaaaacaaua

SEQ ID NO: 800 - RNA, 19 nt, Artificial Sequence
  Synthetic siNA antisense region
uaacauauuuaauauuuaa

SEQ ID NO: 801 - RNA, 19 nt, Artificial Sequence
  Synthetic siNA antisense region
uauauauuaacucuuugcu

SEQ ID NO: 802 - RNA, 19 nt, Artificial Sequence
  Synthetic siNA antisense region
guguucaagguacccuucu

SEQ ID NO: 803 - RNA, 19 nt, Artificial Sequence
  Synthetic siNA antisense region
ucaauguccccucccccag

SEQ ID NO: 804 - RNA, 19 nt, Artificial Sequence
  Synthetic siNA antisense region
gucaaugaaacaacuuguu

SEQ ID NO: 805 - RNA, 19 nt, Artificial Sequence
  Synthetic siNA antisense region
ucuggcuucaguuugauag

SEQ ID NO: 806 - RNA, 19 nt, Artificial Sequence
  Synthetic siNA antisense region
cugucaccaacuuuauuuc

SEQ ID NO: 807 - RNA, 19 nt, Artificial Sequence
  Synthetic Target Sequence/siNA sense region
ccaaggcuccagcccggcc

SEQ ID NO: 808 - RNA, 19 nt, Artificial Sequence
  Synthetic Target Sequence/siNA sense region
cgggcuccgaggcgagagg

SEQ ID NO: 809 - RNA, 19 nt, Artificial Sequence
  Synthetic Target Sequence/siNA sense region
gcugcauggaguggccggc

SEQ ID NO: 810 - RNA, 19 nt, Artificial Sequence
  Synthetic Target Sequence/siNA sense region
cgcggcucugcgggcugug

SEQ ID NO: 811 - RNA, 19 nt, Artificial Sequence
  Synthetic Target Sequence/siNA sense region
gggcgcugcugcucugcgc

SEQ ID NO: 812 - RNA, 19 nt, Artificial Sequence
  Synthetic Target Sequence/siNA sense region
ccggcggcgggggcggggg

SEQ ID NO: 813 - RNA, 19 nt, Artificial Sequence
  Synthetic Target Sequence/siNA sense region
gcgggggcgccgcgccuac

SEQ ID NO: 814 - RNA, 19 nt, Artificial Sequence
  Synthetic Target Sequence/siNA sense region
cggaaacucagccaccugu

SEQ ID NO: 815 - RNA, 19 nt, Artificial Sequence
  Synthetic Target Sequence/siNA sense region
ugacaaauuugagugucuc

SEQ ID NO: 816 - RNA, 19 nt, Artificial Sequence
  Synthetic Target Sequence/siNA sense region
cuguugaaaaccucugcac

SEQ ID NO: 817 - RNA, 19 nt, Artificial Sequence
  Synthetic Target Sequence/siNA sense region
caguaauauggacauggaa

SEQ ID NO: 818 - RNA, 19 nt, Artificial Sequence
  Synthetic Target Sequence/siNA sense region
auccacccgagggagccag

SEQ ID NO: 819 - RNA, 19 nt, Artificial Sequence
  Synthetic Target Sequence/siNA sense region
gcucaaauuguagucuaug

SEQ ID NO: 820 - RNA, 19 nt, Artificial Sequence
  Synthetic Target Sequence/siNA sense region
gguauuuuagucauuuugg

SEQ ID NO: 821 - RNA, 19 nt, Artificial Sequence
  Synthetic Target Sequence/siNA sense region
gcgacaaacaagauaagaa

SEQ ID NO: 822 - RNA, 19 nt, Artificial Sequence
  Synthetic Target Sequence/siNA sense region
aaauagcuccggaaacucg

SEQ ID NO: 823 - RNA, 19 nt, Artificial Sequence
  Synthetic Target Sequence/siNA sense region
gucguucaauagaaguacc

SEQ ID NO: 824 - RNA, 19 nt, Artificial Sequence
  Synthetic Target Sequence/siNA sense region
cccugaaugagaggauuug

SEQ ID NO: 825 - RNA, 19 nt, Artificial Sequence
  Synthetic Target Sequence/siNA sense region
gucugcaagugggguccca

SEQ ID NO: 826 - RNA, 19 nt, Artificial Sequence
  Synthetic Target Sequence/siNA sense region
aguguagcaccaaugagag

SEQ ID NO: 827 - RNA, 19 nt, Artificial Sequence
  Synthetic Target Sequence/siNA sense region
gugagaagccuagcauuuu

SEQ ID NO: 828 - RNA, 19 nt, Artificial Sequence
  Synthetic Target Sequence/siNA sense region
ugguugaaaaaugcaucuc

SEQ ID NO: 829 - RNA, 19 nt, Artificial Sequence
  Synthetic Target Sequence/siNA sense region
cacccccagaaggugaucc

SEQ ID NO: 830 - RNA, 19 nt, Artificial Sequence
  Synthetic Target Sequence/siNA sense region
cugagucugcugugacuga

SEQ ID NO: 831 - RNA, 19 nt, Artificial Sequence
  Synthetic Target Sequence/siNA sense region
agcuucaaugcauuuggca

SEQ ID NO: 832 - RNA, 19 nt, Artificial Sequence
  Synthetic Target Sequence/siNA sense region
acaaccugagcuacaugaa

SEQ ID NO: 833 - RNA, 19 nt, Artificial Sequence
  Synthetic Target Sequence/siNA sense region
aguguucuuggcucccugg

SEQ ID NO: 834 - RNA, 19 nt, Artificial Sequence
  Synthetic Target Sequence/siNA sense region
gaaggaauaccagucccga

SEQ ID NO: 835 - RNA, 19 nt, Artificial Sequence
  Synthetic Target Sequence/siNA sense region
acacuaacuauacucucua

SEQ ID NO: 836 - RNA, 19 nt, Artificial Sequence
  Synthetic Target Sequence/siNA sense region
acuauuggcacagaagccu

SEQ ID NO: 837 - RNA, 19 nt, Artificial Sequence
  Synthetic Target Sequence/siNA sense region
uggaaaaaauucaucaaug

SEQ ID NO: 838 - RNA, 19 nt, Artificial Sequence
  Synthetic Target Sequence/siNA sense region
gugaaaacaucuuuagaga

SEQ ID NO: 839 - RNA, 19 nt, Artificial Sequence
  Synthetic Target Sequence/siNA sense region
aaggccaauacuuugguug

SEQ ID NO: 840 - RNA, 19 nt, Artificial Sequence
  Synthetic Target Sequence/siNA sense region
guuccuuugaucugaccaa

SEQ ID NO: 841 - RNA, 19 nt, Artificial Sequence
  Synthetic Target Sequence/siNA sense region
aagugaaggauuccaguuu

SEQ ID NO: 842 - RNA, 19 nt, Artificial Sequence
  Synthetic Target Sequence/siNA sense region
uugaacaacacagugucca

SEQ ID NO: 843 - RNA, 19 nt, Artificial Sequence
  Synthetic Target Sequence/siNA sense region
aaauaauggucaaggauaa

SEQ ID NO: 844 - RNA, 19 nt, Artificial Sequence
  Synthetic Target Sequence/siNA sense region
augcaggaaaaauuaaacc

SEQ ID NO: 845 - RNA, 19 nt, Artificial Sequence
  Synthetic Target Sequence/siNA sense region
cauccuucaauauagugcc

SEQ ID NO: 846 - RNA, 19 nt, Artificial Sequence
  Synthetic Target Sequence/siNA sense region
cuuuaacuucccgugugaa

SEQ ID NO: 847 - RNA, 19 nt, Artificial Sequence
  Synthetic Target Sequence/siNA sense region
aaccugauccuccacauau

SEQ ID NO: 848 - RNA, 19 nt, Artificial Sequence
  Synthetic Target Sequence/siNA sense region
uuaaaaaccucuccuucca

SEQ ID NO: 849 - RNA, 19 nt, Artificial Sequence
  Synthetic Target Sequence/siNA sense region
acaaugaugaccuauaugu

SEQ ID NO: 850 - RNA, 19 nt, Artificial Sequence
  Synthetic Target Sequence/siNA sense region
ugcaaugggagaauccaca

SEQ ID NO: 851 - RNA, 19 nt, Artificial Sequence
  Synthetic Target Sequence/siNA sense region
agaauuuuauuagcagaug

SEQ ID NO: 852 - RNA, 19 nt, Artificial Sequence
  Synthetic Target Sequence/siNA sense region
gccuauuuuaugaaguaga

SEQ ID NO: 853 - RNA, 19 nt, Artificial Sequence
  Synthetic Target Sequence/siNA sense region
aagucaauaacagccaaac

SEQ ID NO: 854 - RNA, 19 nt, Artificial Sequence
  Synthetic Target Sequence/siNA sense region
cugagacacauaauguuuu

SEQ ID NO: 855 - RNA, 19 nt, Artificial Sequence
  Synthetic Target Sequence/siNA sense region
ucuacguccaagaggcuaa

SEQ ID NO: 856 - RNA, 19 nt, Artificial Sequence
  Synthetic Target Sequence/siNA sense region
aaugugagaauccagaauu

SEQ ID NO: 857 - RNA, 19 nt, Artificial Sequence
  Synthetic Target Sequence/siNA sense region
uugagagaaauguggagaa

SEQ ID NO: 858 - RNA, 19 nt, Artificial Sequence
  Synthetic Target Sequence/siNA sense region
auacaucuuguuucauggu

SEQ ID NO: 859 - RNA, 19 nt, Artificial Sequence
  Synthetic Target Sequence/siNA sense region
ucccugguguucuuccuga

SEQ ID NO: 860 - RNA, 19 nt, Artificial Sequence
  Synthetic Target Sequence/siNA sense region
auacuuugaacacagucag

SEQ ID NO: 861 - RNA, 19 nt, Artificial Sequence
  Synthetic Target Sequence/siNA sense region
gaauaagagucaaaacaaa

SEQ ID NO: 862 - RNA, 19 nt, Artificial Sequence
  Synthetic Target Sequence/siNA sense region
auaaguuaugcuaugagga

SEQ ID NO: 863 - RNA, 19 nt, Artificial Sequence
  Synthetic Target Sequence/siNA sense region
augacaaacucuggaguaa

SEQ ID NO: 864 - RNA, 19 nt, Artificial Sequence
  Synthetic Target Sequence/siNA sense region
auuggagccaagaaaugag

SEQ ID NO: 865 - RNA, 19 nt, Artificial Sequence
  Synthetic Target Sequence/siNA sense region
guauagguaagaagcgcaa

SEQ ID NO: 866 - RNA, 19 nt, Artificial Sequence
  Synthetic Target Sequence/siNA sense region
auuccacacucuacauaac

SEQ ID NO: 867 - RNA, 19 nt, Artificial Sequence
  Synthetic Target Sequence/siNA sense region
ccauguuacucauuguucc

SEQ ID NO: 868 - RNA, 19 nt, Artificial Sequence
  Synthetic Target Sequence/siNA sense region
cagucaucgucgcaggugc

SEQ ID NO: 869 - RNA, 19 nt, Artificial Sequence
  Synthetic Target Sequence/siNA sense region
caaucauaguacuccugcu

SEQ ID NO: 870 - RNA, 19 nt, Artificial Sequence
  Synthetic Target Sequence/siNA sense region
uuuaccuaaaaaggcucaa

SEQ ID NO: 871 - RNA, 19 nt, Artificial Sequence
  Synthetic Target Sequence/siNA sense region
agauuauuauauucccucc

SEQ ID NO: 872 - RNA, 19 nt, Artificial Sequence
  Synthetic Target Sequence/siNA sense region
caauuccugauccuggcaa

SEQ ID NO: 873 - RNA, 19 nt, Artificial Sequence
  Synthetic Target Sequence/siNA sense region
agauuuuuaaagaaauguu

SEQ ID NO: 874 - RNA, 19 nt, Artificial Sequence
  Synthetic Target Sequence/siNA sense region
uuggagaccagaaugauga

SEQ ID NO: 875 - RNA, 19 nt, Artificial Sequence
  Synthetic Target Sequence/siNA sense region
auacucugcacuggaagaa

SEQ ID NO: 876 - RNA, 19 nt, Artificial Sequence
  Synthetic Target Sequence/siNA sense region
aguacgacaucuaugagaa

SEQ ID NO: 877 - RNA, 19 nt, Artificial Sequence
  Synthetic Target Sequence/siNA sense region
agcaaaccaaggaggaaac

SEQ ID NO: 878 - RNA, 19 nt, Artificial Sequence
  Synthetic Target Sequence/siNA sense region
ccgacucuguagugcugau

SEQ ID NO: 879 - RNA, 19 nt, Artificial Sequence
  Synthetic Target Sequence/siNA sense region
uagaaaaccugaagaaagc

SEQ ID NO: 880 - RNA, 19 nt, Artificial Sequence
  Synthetic Target Sequence/siNA sense region
ccucucagugauggagaua

SEQ ID NO: 881 - RNA, 19 nt, Artificial Sequence
  Synthetic Target Sequence/siNA sense region
aauuuauuuuuaccuucac

SEQ ID NO: 882 - RNA, 19 nt, Artificial Sequence
  Synthetic Target Sequence/siNA sense region
cugugaccuugagaagauu

SEQ ID NO: 883 - RNA, 19 nt, Artificial Sequence
  Synthetic Target Sequence/siNA sense region
ucuucccauucuccauuug

SEQ ID NO: 884 - RNA, 19 nt, Artificial Sequence
  Synthetic Target Sequence/siNA sense region
guuaucugggaacuuauua

SEQ ID NO: 885 - RNA, 19 nt, Artificial Sequence
  Synthetic Target Sequence/siNA sense region
aaauggaaacugaaacuac

SEQ ID NO: 886 - RNA, 19 nt, Artificial Sequence
  Synthetic Target Sequence/siNA sense region
cugcaccauuuaaaaacag

SEQ ID NO: 887 - RNA, 19 nt, Artificial Sequence
  Synthetic Target Sequence/siNA sense region
ggcagcucauaagagccac

SEQ ID NO: 888 - RNA, 19 nt, Artificial Sequence
  Synthetic Target Sequence/siNA sense region
caggucuuuauguugaguc

SEQ ID NO: 889 - RNA, 19 nt, Artificial Sequence
  Synthetic Target Sequence/siNA sense region
cgcgcaccgaaaaacuaaa

SEQ ID NO: 890 - RNA, 19 nt, Artificial Sequence
  Synthetic Target Sequence/siNA sense region
aaauaaugggcgcuuugga

SEQ ID NO: 891 - RNA, 19 nt, Artificial Sequence
  Synthetic Target Sequence/siNA sense region
agaagaguguggagucauu

SEQ ID NO: 892 - RNA, 19 nt, Artificial Sequence
  Synthetic Target Sequence/siNA sense region
ucucauugaauuauaaaag

SEQ ID NO: 893 - RNA, 19 nt, Artificial Sequence
  Synthetic Target Sequence/siNA sense region
gccagcaggcuucaaacua

SEQ ID NO: 894 - RNA, 19 nt, Artificial Sequence
  Synthetic Target Sequence/siNA sense region
aggggacaaagcaaaaagu

SEQ ID NO: 895 - RNA, 19 nt, Artificial Sequence
  Synthetic Target Sequence/siNA sense region
ugaugauagugguggaguu

SEQ ID NO: 896 - RNA, 19 nt, Artificial Sequence
  Synthetic Target Sequence/siNA sense region
uaaucuuaucaagaguugu

SEQ ID NO: 897 - RNA, 19 nt, Artificial Sequence
  Synthetic Target Sequence/siNA sense region
ugacaacuuccugagggau

SEQ ID NO: 898 - RNA, 19 nt, Artificial Sequence
  Synthetic Target Sequence/siNA sense region
ucuauacuugcuuuguguu

SEQ ID NO: 899 - RNA, 19 nt, Artificial Sequence
  Synthetic Target Sequence/siNA sense region
ucuuugugucaacaugaac

SEQ ID NO: 900 - RNA, 19 nt, Artificial Sequence
  Synthetic Target Sequence/siNA sense region
caaauuuuauuuguagggg

SEQ ID NO: 901 - RNA, 19 nt, Artificial Sequence
  Synthetic Target Sequence/siNA sense region
gaacucauuuggggugcaa

SEQ ID NO: 902 - RNA, 19 nt, Artificial Sequence
  Synthetic Target Sequence/siNA sense region
aaugcuaaugucaaacuug

SEQ ID NO: 903 - RNA, 19 nt, Artificial Sequence
  Synthetic Target Sequence/siNA sense region
gagucacaaagaacaugua

SEQ ID NO: 904 - RNA, 19 nt, Artificial Sequence
  Synthetic Target Sequence/siNA sense region
agaaaacaaaauggauaaa

SEQ ID NO: 905 - RNA, 19 nt, Artificial Sequence
  Synthetic Target Sequence/siNA sense region
aaucugauauguauuguuu

SEQ ID NO: 906 - RNA, 19 nt, Artificial Sequence
  Synthetic Target Sequence/siNA sense region
ugggauccuauugaaccau

SEQ ID NO: 907 - RNA, 19 nt, Artificial Sequence
  Synthetic Target Sequence/siNA sense region
uguuuguggcuauuaaaac

SEQ ID NO: 908 - RNA, 19 nt, Artificial Sequence
  Synthetic Target Sequence/siNA sense region
cucuuuuaacagucugggc

SEQ ID NO: 909 - RNA, 19 nt, Artificial Sequence
  Synthetic Target Sequence/siNA sense region
cuggguccgguggcucacg

SEQ ID NO: 910 - RNA, 19 nt, Artificial Sequence
  Synthetic Target Sequence/siNA sense region
gccuguaaucccagcaauu

SEQ ID NO: 911 - RNA, 19 nt, Artificial Sequence
  Synthetic Target Sequence/siNA sense region
uugggaguccgaggcgggc

SEQ ID NO: 912 - RNA, 19 nt, Artificial Sequence
  Synthetic Target Sequence/siNA sense region
cggaucacucgaggucagg

SEQ ID NO: 913 - RNA, 19 nt, Artificial Sequence
  Synthetic Target Sequence/siNA sense region
gaguuccagaccagccuga

SEQ ID NO: 914 - RNA, 19 nt, Artificial Sequence
  Synthetic Target Sequence/siNA sense region
accaaaauggugaaaccuc

SEQ ID NO: 915 - RNA, 19 nt, Artificial Sequence
  Synthetic Target Sequence/siNA sense region
ccucucuacuaaaacuaca

SEQ ID NO: 916 - RNA, 19 nt, Artificial Sequence
  Synthetic Target Sequence/siNA sense region
aaaaauuaacugggugugg

SEQ ID NO: 917 - RNA, 19 nt, Artificial Sequence
  Synthetic Target Sequence/siNA sense region
guggcgcgugccuguaauc

SEQ ID NO: 918 - RNA, 19 nt, Artificial Sequence
  Synthetic Target Sequence/siNA sense region
cccagcuacucgggaagcu

SEQ ID NO: 919 - RNA, 19 nt, Artificial Sequence
  Synthetic Target Sequence/siNA sense region
ugaggcaggugaauuguuu

SEQ ID NO: 920 - RNA, 19 nt, Artificial Sequence
  Synthetic Target Sequence/siNA sense region
ugaaccugggagguggagg

SEQ ID NO: 921 - RNA, 19 nt, Artificial Sequence
  Synthetic Target Sequence/siNA sense region
guugcagugagcagagauc

SEQ ID NO: 922 - RNA, 19 nt, Artificial Sequence
  Synthetic Target Sequence/siNA sense region
cacaccacugcacucuagc

SEQ ID NO: 923 - RNA, 19 nt, Artificial Sequence
  Synthetic Target Sequence/siNA sense region
ccugggugacagagcaaga

SEQ ID NO: 924 - RNA, 19 nt, Artificial Sequence
  Synthetic Target Sequence/siNA sense region
acucugucuaaaaaacaaa

SEQ ID NO: 925 - RNA, 19 nt, Artificial Sequence
  Synthetic Target Sequence/siNA sense region
aacaaaacaaaacaaaaca

SEQ ID NO: 926 - RNA, 19 nt, Artificial Sequence
  Synthetic Target Sequence/siNA sense region
aaaaaaaccucuuaauauu

SEQ ID NO: 927 - RNA, 19 nt, Artificial Sequence
  Synthetic Target Sequence/siNA sense region
ucuggagucaucauucccu

SEQ ID NO: 928 - RNA, 19 nt, Artificial Sequence
  Synthetic Target Sequence/siNA sense region
uucgacagcauuuuccucu

SEQ ID NO: 929 - RNA, 19 nt, Artificial Sequence
  Synthetic Target Sequence/siNA sense region
ugcuuugaaagccccagaa

SEQ ID NO: 930 - RNA, 19 nt, Artificial Sequence
  Synthetic Target Sequence/siNA sense region
aaucaguguuggccaugau

SEQ ID NO: 931 - RNA, 19 nt, Artificial Sequence
  Synthetic Target Sequence/siNA sense region
ugacaacuacagaaaaacc

SEQ ID NO: 932 - RNA, 19 nt, Artificial Sequence
  Synthetic Target Sequence/siNA sense region
cagaggcagcuucuuugcc

SEQ ID NO: 933 - RNA, 19 nt, Artificial Sequence
  Synthetic Target Sequence/siNA sense region
caagaccuuucaaagccau

SEQ ID NO: 934 - RNA, 19 nt, Artificial Sequence
  Synthetic Target Sequence/siNA sense region
uuuuaggcuguuaggggca

SEQ ID NO: 935 - RNA, 19 nt, Artificial Sequence
  Synthetic Target Sequence/siNA sense region
aguggagguagaaugacuc

SEQ ID NO: 936 - RNA, 19 nt, Artificial Sequence
  Synthetic Target Sequence/siNA sense region
ccuuggguauuagaguuuc

SEQ ID NO: 937 - RNA, 19 nt, Artificial Sequence
  Synthetic Target Sequence/siNA sense region
caaccaugaagucucuaac

SEQ ID NO: 938 - RNA, 19 nt, Artificial Sequence
  Synthetic Target Sequence/siNA sense region
caauguauuuucuucaccu

SEQ ID NO: 939 - RNA, 19 nt, Artificial Sequence
  Synthetic Target Sequence/siNA sense region
ucugcuacucaaguagcau

SEQ ID NO: 940 - RNA, 19 nt, Artificial Sequence
  Synthetic Target Sequence/siNA sense region
uuuacugugucuuugguuu

SEQ ID NO: 941 - RNA, 19 nt, Artificial Sequence
  Synthetic Target Sequence/siNA sense region
ugugcuaggcccccgggug

SEQ ID NO: 942 - RNA, 19 nt, Artificial Sequence
  Synthetic Target Sequence/siNA sense region
gugaagcacagaccccuuc

SEQ ID NO: 943 - RNA, 19 nt, Artificial Sequence
  Synthetic Target Sequence/siNA sense region
ccagggguuuacagucuau

SEQ ID NO: 944 - RNA, 19 nt, Artificial Sequence
  Synthetic Target Sequence/siNA sense region
uuugagacuccucaguucu

SEQ ID NO: 945 - RNA, 19 nt, Artificial Sequence
  Synthetic Target Sequence/siNA sense region
uugccacuuuuuuuuuuaa

SEQ ID NO: 946 - RNA, 19 nt, Artificial Sequence
  Synthetic Target Sequence/siNA sense region
aucuccaccagucauuuuu

SEQ ID NO: 947 - RNA, 19 nt, Artificial Sequence
  Synthetic Target Sequence/siNA sense region
ucagaccuuuuaacuccuc

SEQ ID NO: 948 - RNA, 19 nt, Artificial Sequence
  Synthetic Target Sequence/siNA sense region
caauuccaacacugauuuc

SEQ ID NO: 949 - RNA, 19 nt, Artificial Sequence
  Synthetic Target Sequence/siNA sense region
ccccuuuugcauucucccu

SEQ ID NO: 950 - RNA, 19 nt, Artificial Sequence
  Synthetic Target Sequence/siNA sense region
uccuucccuuccuuguagc

SEQ ID NO: 951 - RNA, 19 nt, Artificial Sequence
  Synthetic Target Sequence/siNA sense region
ccuuuugacuuucauugga

SEQ ID NO: 952 - RNA, 19 nt, Artificial Sequence
  Synthetic Target Sequence/siNA sense region
aaauuaggauguaaaucug

SEQ ID NO: 953 - RNA, 19 nt, Artificial Sequence
  Synthetic Target Sequence/siNA sense region
gcucaggagaccuggagga

SEQ ID NO: 954 - RNA, 19 nt, Artificial Sequence
  Synthetic Target Sequence/siNA sense region
agcagaggauaauuagcau

SEQ ID NO: 955 - RNA, 19 nt, Artificial Sequence
  Synthetic Target Sequence/siNA sense region
ucucagguuaagugugagu

SEQ ID NO: 956 - RNA, 19 nt, Artificial Sequence
  Synthetic Target Sequence/siNA sense region
uaaucugagaaacaaugac

SEQ ID NO: 957 - RNA, 19 nt, Artificial Sequence
  Synthetic Target Sequence/siNA sense region
cuaauucuugcauauuuug

SEQ ID NO: 958 - RNA, 19 nt, Artificial Sequence
  Synthetic Target Sequence/siNA sense region
guaacuuccaugugagggu

SEQ ID NO: 959 - RNA, 19 nt, Artificial Sequence
  Synthetic Target Sequence/siNA sense region
uuuucagcauugauauuug

SEQ ID NO: 960 - RNA, 19 nt, Artificial Sequence
  Synthetic Target Sequence/siNA sense region
gugcauuuucuaaacagag

SEQ ID NO: 961 - RNA, 19 nt, Artificial Sequence
  Synthetic Target Sequence/siNA sense region
gaugaggugguaucuucac

SEQ ID NO: 962 - RNA, 19 nt, Artificial Sequence
  Synthetic Target Sequence/siNA sense region
cguagaacauugguauucg

SEQ ID NO: 963 - RNA, 19 nt, Artificial Sequence
  Synthetic Target Sequence/siNA sense region
gcuugagaaaaaaagaaua

SEQ ID NO: 964 - RNA, 19 nt, Artificial Sequence
  Synthetic Target Sequence/siNA sense region
aguugaaccuauuucucuu

SEQ ID NO: 965 - RNA, 19 nt, Artificial Sequence
  Synthetic Target Sequence/siNA sense region
uucuuuacaagaugggucc

SEQ ID NO: 966 - RNA, 19 nt, Artificial Sequence
  Synthetic Target Sequence/siNA sense region
caggauuccucuuuucucu

SEQ ID NO: 967 - RNA, 19 nt, Artificial Sequence
  Synthetic Target Sequence/siNA sense region
ugccauaaaugauuaauua

SEQ ID NO: 968 - RNA, 19 nt, Artificial Sequence
  Synthetic Target Sequence/siNA sense region
aaauagcuuuugugucuua

SEQ ID NO: 969 - RNA, 19 nt, Artificial Sequence
  Synthetic Target Sequence/siNA sense region
acauugguagccagccagc

SEQ ID NO: 970 - RNA, 19 nt, Artificial Sequence
  Synthetic Target Sequence/siNA sense region
ccaaggcucuguuuaugcu

SEQ ID NO: 971 - RNA, 19 nt, Artificial Sequence
  Synthetic Target Sequence/siNA sense region
uuuuggggggcauauauug

SEQ ID NO: 972 - RNA, 19 nt, Artificial Sequence
  Synthetic Target Sequence/siNA sense region
ggguuccauucucaccuau

SEQ ID NO: 973 - RNA, 19 nt, Artificial Sequence
  Synthetic Target Sequence/siNA sense region
uccacacaacauauccgua

SEQ ID NO: 974 - RNA, 19 nt, Artificial Sequence
  Synthetic Target Sequence/siNA sense region
auauauccccucuacucuu

SEQ ID NO: 975 - RNA, 19 nt, Artificial Sequence
  Synthetic Target Sequence/siNA sense region
uacuucccccaaauuuaaa

SEQ ID NO: 976 - RNA, 19 nt, Artificial Sequence
  Synthetic Target Sequence/siNA sense region
agaaguaugggaaaugaga

SEQ ID NO: 977 - RNA, 19 nt, Artificial Sequence
  Synthetic Target Sequence/siNA sense region
aggcauuucccccacccca

SEQ ID NO: 978 - RNA, 19 nt, Artificial Sequence
  Synthetic Target Sequence/siNA sense region
auuucucuccucacacaca

SEQ ID NO: 979 - RNA, 19 nt, Artificial Sequence
  Synthetic Target Sequence/siNA sense region
agacucauauuacugguag

SEQ ID NO: 980 - RNA, 19 nt, Artificial Sequence
  Synthetic Target Sequence/siNA sense region
ggaacuugagaacuuuauu

SEQ ID NO: 981 - RNA, 19 nt, Artificial Sequence
  Synthetic Target Sequence/siNA sense region
uuccaaguuguucaaacau

SEQ ID NO: 982 - RNA, 19 nt, Artificial Sequence
  Synthetic Target Sequence/siNA sense region
uuuaccaaucauauuaaua

SEQ ID NO: 983 - RNA, 19 nt, Artificial Sequence
  Synthetic Target Sequence/siNA sense region
acaaugaugcuauuugcaa

SEQ ID NO: 984 - RNA, 19 nt, Artificial Sequence
  Synthetic Target Sequence/siNA sense region
auuccugcuccuaggggag

SEQ ID NO: 985 - RNA, 19 nt, Artificial Sequence
  Synthetic Target Sequence/siNA sense region
ggggagauaagaaacccuc

SEQ ID NO: 986 - RNA, 19 nt, Artificial Sequence
  Synthetic Target Sequence/siNA sense region
cacucucuacagguuuggg

SEQ ID NO: 987 - RNA, 19 nt, Artificial Sequence
  Synthetic Target Sequence/siNA sense region
guacaaguggcaaccugcu

SEQ ID NO: 988 - RNA, 19 nt, Artificial Sequence
  Synthetic Target Sequence/siNA sense region
uuccauggccguguagaag

SEQ ID NO: 989 - RNA, 19 nt, Artificial Sequence
  Synthetic Target Sequence/siNA sense region
gcauggugcccuggcuucu

SEQ ID NO: 990 - RNA, 19 nt, Artificial Sequence
  Synthetic Target Sequence/siNA sense region
ucugaggaagcugggguuc

SEQ ID NO: 991 - RNA, 19 nt, Artificial Sequence
  Synthetic Target Sequence/siNA sense region
caugacaauggcagaugua

SEQ ID NO: 992 - RNA, 19 nt, Artificial Sequence
  Synthetic Target Sequence/siNA sense region
aaaguuauucuugaaguca

SEQ ID NO: 993 - RNA, 19 nt, Artificial Sequence
  Synthetic Target Sequence/siNA sense region
agauugaggcugggagaca

SEQ ID NO: 994 - RNA, 19 nt, Artificial Sequence
  Synthetic Target Sequence/siNA sense region
agccguaguagauguucua

SEQ ID NO: 995 - RNA, 19 nt, Artificial Sequence
  Synthetic Target Sequence/siNA sense region
acuuuguucugcuguucuc

SEQ ID NO: 996 - RNA, 19 nt, Artificial Sequence
  Synthetic Target Sequence/siNA sense region
cuagaaagaauauuugguu

SEQ ID NO: 997 - RNA, 19 nt, Artificial Sequence
  Synthetic Target Sequence/siNA sense region
uuuccuguauaggaaugag

SEQ ID NO: 998 - RNA, 19 nt, Artificial Sequence
  Synthetic Target Sequence/siNA sense region
gauuaauuccuuuccaggu

SEQ ID NO: 999 - RNA, 19 nt, Artificial Sequence
  Synthetic Target Sequence/siNA sense region
uauuuuauaauucugggaa

SEQ ID NO: 1000 - RNA, 19 nt, Artificial Sequence
  Synthetic Target Sequence/siNA sense region
agcaaaacccaugccuccc

SEQ ID NO: 1001 - RNA, 19 nt, Artificial Sequence
  Synthetic Target Sequence/siNA sense region
cccuagccauuuuuacugu

SEQ ID NO: 1002 - RNA, 19 nt, Artificial Sequence
  Synthetic Target Sequence/siNA sense region
uuauccuauuuagauggcc

SEQ ID NO: 1003 - RNA, 19 nt, Artificial Sequence
  Synthetic Target Sequence/siNA sense region
caugaagaggaugcuguga

SEQ ID NO: 1004 - RNA, 19 nt, Artificial Sequence
  Synthetic Target Sequence/siNA sense region
aaauucccaacaaacauug

SEQ ID NO: 1005 - RNA, 19 nt, Artificial Sequence
  Synthetic Target Sequence/siNA sense region
gaugcugacagucaugcag

SEQ ID NO: 1006 - RNA, 19 nt, Artificial Sequence
  Synthetic Target Sequence/siNA sense region
gucugggaguggggaagug

SEQ ID NO: 1007 - RNA, 19 nt, Artificial Sequence
  Synthetic Target Sequence/siNA sense region
gaucuuuuguucccauccu

SEQ ID NO: 1008 - RNA, 19 nt, Artificial Sequence
  Synthetic Target Sequence/siNA sense region
ucuucuuuuagcaguaaaa

SEQ ID NO: 1009 - RNA, 19 nt, Artificial Sequence
  Synthetic Target Sequence/siNA sense region
auagcugagggaaaaggga

SEQ ID NO: 1010 - RNA, 19 nt, Artificial Sequence
  Synthetic Target Sequence/siNA sense region
agggaaaaggaaguuaugg

SEQ ID NO: 1011 - RNA, 19 nt, Artificial Sequence
  Synthetic Target Sequence/siNA sense region
ggaauaccuguggugguug

SEQ ID NO: 1012 - RNA, 19 nt, Artificial Sequence
  Synthetic Target Sequence/siNA sense region
gugaucccuaggucuuggg

SEQ ID NO: 1013 - RNA, 19 nt, Artificial Sequence
  Synthetic Target Sequence/siNA sense region
gagcucuuggaggugucug

SEQ ID NO: 1014 - RNA, 19 nt, Artificial Sequence
  Synthetic Target Sequence/siNA sense region
guaucaguggauuucccau

SEQ ID NO: 1015 - RNA, 19 nt, Artificial Sequence
  Synthetic Target Sequence/siNA sense region
uccccugugggaaauuagu

SEQ ID NO: 1016 - RNA, 19 nt, Artificial Sequence
  Synthetic Target Sequence/siNA sense region
uaggcucauuuacuguuuu

SEQ ID NO: 1017 - RNA, 19 nt, Artificial Sequence
  Synthetic Target Sequence/siNA sense region
uaggucuagccuaugugga

SEQ ID NO: 1018 - RNA, 19 nt, Artificial Sequence
  Synthetic Target Sequence/siNA sense region
auuuuuuccuaacauaccu

SEQ ID NO: 1019 - RNA, 19 nt, Artificial Sequence
  Synthetic Target Sequence/siNA sense region
uaagcaaacccagugucag

SEQ ID NO: 1020 - RNA, 19 nt, Artificial Sequence
  Synthetic Target Sequence/siNA sense region
ggaugguaauucuuauucu

SEQ ID NO: 1021 - RNA, 19 nt, Artificial Sequence
  Synthetic Target Sequence/siNA sense region
uuucguucaguuaaguuuu

SEQ ID NO: 1022 - RNA, 19 nt, Artificial Sequence
  Synthetic Target Sequence/siNA sense region
uucccuucaucugggcacu

SEQ ID NO: 1023 - RNA, 19 nt, Artificial Sequence
  Synthetic Target Sequence/siNA sense region
ugaagggauaugugaaaca

SEQ ID NO: 1024 - RNA, 19 nt, Artificial Sequence
  Synthetic Target Sequence/siNA sense region
aauguuaacauuuuuggua

SEQ ID NO: 1025 - RNA, 19 nt, Artificial Sequence
  Synthetic Target Sequence/siNA sense region
agucuucaaccagggauug

SEQ ID NO: 1026 - RNA, 19 nt, Artificial Sequence
  Synthetic Target Sequence/siNA sense region
guuucuguuuaacuucuua

SEQ ID NO: 1027 - RNA, 19 nt, Artificial Sequence
  Synthetic Target Sequence/siNA sense region
auaggaaagcuugaguaaa

SEQ ID NO: 1028 - RNA, 19 nt, Artificial Sequence
  Synthetic Target Sequence/siNA sense region
aauaaauauugucuuuuug

SEQ ID NO: 1029 - RNA, 19 nt, Artificial Sequence
  Synthetic Target Sequence/siNA sense region
auauugucuuuuuguaugu

SEQ ID NO: 1030 - RNA, 19 nt, Artificial Sequence
  Synthetic siNA antisense region
ggccgggcuggagccuugg

SEQ ID NO: 1031 - RNA, 19 nt, Artificial Sequence
  Synthetic siNA antisense region
ccucucgccucggagcccg

SEQ ID NO: 1032 - RNA, 19 nt, Artificial Sequence
  Synthetic siNA antisense region
gccggccacuccaugcagc

SEQ ID NO: 1033 - RNA, 19 nt, Artificial Sequence
  Synthetic siNA antisense region
cacagcccgcagagccgcg

SEQ ID NO: 1034 - RNA, 19 nt, Artificial Sequence
  Synthetic siNA antisense region
gcgcagagcagcagcgccc

SEQ ID NO: 1035 - RNA, 19 nt, Artificial Sequence
  Synthetic siNA antisense region
cccccgcccccgccgccgg

SEQ ID NO: 1036 - RNA, 19 nt, Artificial Sequence
  Synthetic siNA antisense region
guaggcgcggcgcccccgc

SEQ ID NO: 1037 - RNA, 19 nt, Artificial Sequence
  Synthetic siNA antisense region
acagguggcugaguuuccg

SEQ ID NO: 1038 - RNA, 19 nt, Artificial Sequence
  Synthetic siNA antisense region
gagacacucaaauuuguca

SEQ ID NO: 1039 - RNA, 19 nt, Artificial Sequence
  Synthetic siNA antisense region
gugcagagguuuucaacag

SEQ ID NO: 1040 - RNA, 19 nt, Artificial Sequence
  Synthetic siNA antisense region
uuccauguccauauuacug

SEQ ID NO: 1041 - RNA, 19 nt, Artificial Sequence
  Synthetic siNA antisense region
cuggcucccucggguggau

SEQ ID NO: 1042 - RNA, 19 nt, Artificial Sequence
  Synthetic siNA antisense region
cauagacuacaauuugagc

SEQ ID NO: 1043 - RNA, 19 nt, Artificial Sequence
  Synthetic siNA antisense region
ccaaaaugacuaaaauacc

SEQ ID NO: 1044 - RNA, 19 nt, Artificial Sequence
  Synthetic siNA antisense region
uucuuaucuuguuugucgc

SEQ ID NO: 1045 - RNA, 19 nt, Artificial Sequence
  Synthetic siNA antisense region
cgaguuuccggagcuauuu

SEQ ID NO: 1046 - RNA, 19 nt, Artificial Sequence
  Synthetic siNA antisense region
gguacuucuauugaacgac

SEQ ID NO: 1047 - RNA, 19 nt, Artificial Sequence
  Synthetic siNA antisense region
caaauccucucauucaggg

SEQ ID NO: 1048 - RNA, 19 nt, Artificial Sequence
  Synthetic siNA antisense region
ugggaccccacuugcagac

SEQ ID NO: 1049 - RNA, 19 nt, Artificial Sequence
  Synthetic siNA antisense region
cucucauuggugcuacacu

SEQ ID NO: 1050 - RNA, 19 nt, Artificial Sequence
  Synthetic siNA antisense region
aaaaugcuaggcuucucac

SEQ ID NO: 1051 - RNA, 19 nt, Artificial Sequence
  Synthetic siNA antisense region
gagaugcauuuuucaacca

SEQ ID NO: 1052 - RNA, 19 nt, Artificial Sequence
  Synthetic siNA antisense region
ggaucaccuucugggggug

SEQ ID NO: 1053 - RNA, 19 nt, Artificial Sequence
  Synthetic siNA antisense region
ucagucacagcagacucag

SEQ ID NO: 1054 - RNA, 19 nt, Artificial Sequence
  Synthetic siNA antisense region
ugccaaaugcauugaagcu

SEQ ID NO: 1055 - RNA, 19 nt, Artificial Sequence
  Synthetic siNA antisense region
uucauguagcucagguugu

SEQ ID NO: 1056 - RNA, 19 nt, Artificial Sequence
  Synthetic siNA antisense region
ccagggagccaagaacacu

SEQ ID NO: 1057 - RNA, 19 nt, Artificial Sequence
  Synthetic siNA antisense region
ucgggacugguauuccuuc

SEQ ID NO: 1058 - RNA, 19 nt, Artificial Sequence
  Synthetic siNA antisense region
uagagaguauaguuagugu

SEQ ID NO: 1059 - RNA, 19 nt, Artificial Sequence
  Synthetic siNA antisense region
aggcuucugugccaauagu

SEQ ID NO: 1060 - RNA, 19 nt, Artificial Sequence
  Synthetic siNA antisense region
cauugaugaauuuuuucca

SEQ ID NO: 1061 - RNA, 19 nt, Artificial Sequence
  Synthetic siNA antisense region
ucucuaaagauguuuucac

SEQ ID NO: 1062 - RNA, 19 nt, Artificial Sequence
  Synthetic siNA antisense region
caaccaaaguauuggccuu

SEQ ID NO: 1063 - RNA, 19 nt, Artificial Sequence
  Synthetic siNA antisense region
uuggucagaucaaaggaac

SEQ ID NO: 1064 - RNA, 19 nt, Artificial Sequence
  Synthetic siNA antisense region
aaacuggaauccuucacuu

SEQ ID NO: 1065 - RNA, 19 nt, Artificial Sequence
  Synthetic siNA antisense region
uggacacuguguuguucaa

SEQ ID NO: 1066 - RNA, 19 nt, Artificial Sequence
  Synthetic siNA antisense region
uuauccuugaccauuauuu

SEQ ID NO: 1067 - RNA, 19 nt, Artificial Sequence
  Synthetic siNA antisense region
gguuuaauuuuuccugcau

SEQ ID NO: 1068 - RNA, 19 nt, Artificial Sequence
  Synthetic siNA antisense region
ggcacuauauugaaggaug

SEQ ID NO: 1069 - RNA, 19 nt, Artificial Sequence
  Synthetic siNA antisense region
uucacacgggaaguuaaag

SEQ ID NO: 1070 - RNA, 19 nt, Artificial Sequence
  Synthetic siNA antisense region
auauguggaggaucagguu

SEQ ID NO: 1071 - RNA, 19 nt, Artificial Sequence
  Synthetic siNA antisense region
uggaaggagagguuuuuaa

SEQ ID NO: 1072 - RNA, 19 nt, Artificial Sequence
  Synthetic siNA antisense region
acauauaggucaucauugu

SEQ ID NO: 1073 - RNA, 19 nt, Artificial Sequence
  Synthetic siNA antisense region
uguggauucucccauugca

SEQ ID NO: 1074 - RNA, 19 nt, Artificial Sequence
  Synthetic siNA antisense region
caucugcuaauaaaauucu

SEQ ID NO: 1075 - RNA, 19 nt, Artificial Sequence
  Synthetic siNA antisense region
ucuacuucauaaaauaggc

SEQ ID NO: 1076 - RNA, 19 nt, Artificial Sequence
  Synthetic siNA antisense region
guuuggcuguuauugacuu

SEQ ID NO: 1077 - RNA, 19 nt, Artificial Sequence
  Synthetic siNA antisense region
aaaacauuaugugucucag

SEQ ID NO: 1078 - RNA, 19 nt, Artificial Sequence
  Synthetic siNA antisense region
uuagccucuuggacguaga

SEQ ID NO: 1079 - RNA, 19 nt, Artificial Sequence
  Synthetic siNA antisense region
aauucuggauucucacauu

SEQ ID NO: 1080 - RNA, 19 nt, Artificial Sequence
  Synthetic siNA antisense region
uucuccacauuucucucaa

SEQ ID NO: 1081 - RNA, 19 nt, Artificial Sequence
  Synthetic siNA antisense region
accaugaaacaagauguau

SEQ ID NO: 1082 - RNA, 19 nt, Artificial Sequence
  Synthetic siNA antisense region
ucaggaagaacaccaggga

SEQ ID NO: 1083 - RNA, 19 nt, Artificial Sequence
  Synthetic siNA antisense region
cugacuguguucaaaguau

SEQ ID NO: 1084 - RNA, 19 nt, Artificial Sequence
  Synthetic siNA antisense region
uuuguuuugacucuuauuc

SEQ ID NO: 1085 - RNA, 19 nt, Artificial Sequence
  Synthetic siNA antisense region
uccucauagcauaacuuau

SEQ ID NO: 1086 - RNA, 19 nt, Artificial Sequence
  Synthetic siNA antisense region
uuacuccagaguuugucau

SEQ ID NO: 1087 - RNA, 19 nt, Artificial Sequence
  Synthetic siNA antisense region
cucauuucuuggcuccaau

SEQ ID NO: 1088 - RNA, 19 nt, Artificial Sequence
  Synthetic siNA antisense region
uugcgcuucuuaccuauac

SEQ ID NO: 1089 - RNA, 19 nt, Artificial Sequence
  Synthetic siNA antisense region
guuauguagaguguggaau

SEQ ID NO: 1090 - RNA, 19 nt, Artificial Sequence
  Synthetic siNA antisense region
ggaacaaugaguaacaugg

SEQ ID NO: 1091 - RNA, 19 nt, Artificial Sequence
  Synthetic siNA antisense region
gcaccugcgacgaugacug

SEQ ID NO: 1092 - RNA, 19 nt, Artificial Sequence
  Synthetic siNA antisense region
agcaggaguacuaugauug

SEQ ID NO: 1093 - RNA, 19 nt, Artificial Sequence
  Synthetic siNA antisense region
uugagccuuuuuagguaaa

SEQ ID NO: 1094 - RNA, 19 nt, Artificial Sequence
  Synthetic siNA antisense region
ggagggaauauaauaaucu

SEQ ID NO: 1095 - RNA, 19 nt, Artificial Sequence
  Synthetic siNA antisense region
uugccaggaucaggaauug

SEQ ID NO: 1096 - RNA, 19 nt, Artificial Sequence
  Synthetic siNA antisense region
aacauuucuuuaaaaaucu

SEQ ID NO: 1097 - RNA, 19 nt, Artificial Sequence
  Synthetic siNA antisense region
ucaucauucuggucuccaa

SEQ ID NO: 1098 - RNA, 19 nt, Artificial Sequence
  Synthetic siNA antisense region
uucuuccagugcagaguau

SEQ ID NO: 1099 - RNA, 19 nt, Artificial Sequence
  Synthetic siNA antisense region
uucucauagaugucguacu

SEQ ID NO: 1100 - RNA, 19 nt, Artificial Sequence
  Synthetic siNA antisense region
guuuccuccuugguuugcu

SEQ ID NO: 1101 - RNA, 19 nt, Artificial Sequence
  Synthetic siNA antisense region
aucagcacuacagagucgg

SEQ ID NO: 1102 - RNA, 19 nt, Artificial Sequence
  Synthetic siNA antisense region
gcuuucuucagguuuucua

SEQ ID NO: 1103 - RNA, 19 nt, Artificial Sequence
  Synthetic siNA antisense region
uaucuccaucacugagagg

SEQ ID NO: 1104 - RNA, 19 nt, Artificial Sequence
  Synthetic siNA antisense region
gugaagguaaaaauaaauu

SEQ ID NO: 1105 - RNA, 19 nt, Artificial Sequence
  Synthetic siNA antisense region
aaucuucucaaggucacag

SEQ ID NO: 1106 - RNA, 19 nt, Artificial Sequence
  Synthetic siNA antisense region
caaauggagaaugggaaga

SEQ ID NO: 1107 - RNA, 19 nt, Artificial Sequence
  Synthetic siNA antisense region
uaauaaguucccagauaac

SEQ ID NO: 1108 - RNA, 19 nt, Artificial Sequence
  Synthetic siNA antisense region
guaguuucaguuuccauuu

SEQ ID NO: 1109 - RNA, 19 nt, Artificial Sequence
  Synthetic siNA antisense region
cuguuuuuaaauggugcag

SEQ ID NO: 1110 - RNA, 19 nt, Artificial Sequence
  Synthetic siNA antisense region
guggcucuuaugagcugcc

SEQ ID NO: 1111 - RNA, 19 nt, Artificial Sequence
  Synthetic siNA antisense region
gacucaacauaaagaccug

SEQ ID NO: 1112 - RNA, 19 nt, Artificial Sequence
  Synthetic siNA antisense region
uuuaguuuuucggugcgcg

SEQ ID NO: 1113 - RNA, 19 nt, Artificial Sequence
  Synthetic siNA antisense region
uccaaagcgcccauuauuu

SEQ ID NO: 1114 - RNA, 19 nt, Artificial Sequence
  Synthetic siNA antisense region
aaugacuccacacucuucu

SEQ ID NO: 1115 - RNA, 19 nt, Artificial Sequence
  Synthetic siNA antisense region
cuuuuauaauucaaugaga

SEQ ID NO: 1116 - RNA, 19 nt, Artificial Sequence
  Synthetic siNA antisense region
uaguuugaagccugcuggc

SEQ ID NO: 1117 - RNA, 19 nt, Artificial Sequence
  Synthetic siNA antisense region
acuuuuugcuuuguccccu

SEQ ID NO: 1118 - RNA, 19 nt, Artificial Sequence
  Synthetic siNA antisense region
aacuccaccacuaucauca

SEQ ID NO: 1119 - RNA, 19 nt, Artificial Sequence
  Synthetic siNA antisense region
acaacucuugauaagauua

SEQ ID NO: 1120 - RNA, 19 nt, Artificial Sequence
  Synthetic siNA antisense region
aucccucaggaaguuguca

SEQ ID NO: 1121 - RNA, 19 nt, Artificial Sequence
  Synthetic siNA antisense region
aacacaaagcaaguauaga

SEQ ID NO: 1122 - RNA, 19 nt, Artificial Sequence
  Synthetic siNA antisense region
guucauguugacacaaaga

SEQ ID NO: 1123 - RNA, 19 nt, Artificial Sequence
  Synthetic siNA antisense region
ccccuacaaauaaaauuug

SEQ ID NO: 1124 - RNA, 19 nt, Artificial Sequence
  Synthetic siNA antisense region
uugcaccccaaaugaguuc

SEQ ID NO: 1125 - RNA, 19 nt, Artificial Sequence
  Synthetic siNA antisense region
caaguuugacauuagcauu

SEQ ID NO: 1126 - RNA, 19 nt, Artificial Sequence
  Synthetic siNA antisense region
uacauguucuuugugacuc

SEQ ID NO: 1127 - RNA, 19 nt, Artificial Sequence
  Synthetic siNA antisense region
uuuauccauuuuguuuucu

SEQ ID NO: 1128 - RNA, 19 nt, Artificial Sequence
  Synthetic siNA antisense region
aaacaauacauaucagauu

SEQ ID NO: 1129 - RNA, 19 nt, Artificial Sequence
  Synthetic siNA antisense region
augguucaauaggauccca

SEQ ID NO: 1130 - RNA, 19 nt, Artificial Sequence
  Synthetic siNA antisense region
guuuuaauagccacaaaca

SEQ ID NO: 1131 - RNA, 19 nt, Artificial Sequence
  Synthetic siNA antisense region
gcccagacuguuaaaagag

SEQ ID NO: 1132 - RNA, 19 nt, Artificial Sequence
  Synthetic siNA antisense region
cgugagccaccggacccag

SEQ ID NO: 1133 - RNA, 19 nt, Artificial Sequence
  Synthetic siNA antisense region
aauugcugggauuacaggc

SEQ ID NO: 1134 - RNA, 19 nt, Artificial Sequence
  Synthetic siNA antisense region
gcccgccucggacucccaa

SEQ ID NO: 1135 - RNA, 19 nt, Artificial Sequence
  Synthetic siNA antisense region
ccugaccucgagugauccg

SEQ ID NO: 1136 - RNA, 19 nt, Artificial Sequence
  Synthetic siNA antisense region
ucaggcuggucuggaacuc

SEQ ID NO: 1137 - RNA, 19 nt, Artificial Sequence
  Synthetic siNA antisense region
gagguuucaccauuuuggu

SEQ ID NO: 1138 - RNA, 19 nt, Artificial Sequence
  Synthetic siNA antisense region
uguaguuuuaguagagagg

SEQ ID NO: 1139 - RNA, 19 nt, Artificial Sequence
  Synthetic siNA antisense region
ccacacccaguuaauuuuu

SEQ ID NO: 1140 - RNA, 19 nt, Artificial Sequence
  Synthetic siNA antisense region
gauuacaggcacgcgccac

SEQ ID NO: 1141 - RNA, 19 nt, Artificial Sequence
  Synthetic siNA antisense region
agcuucccgaguagcuggg

SEQ ID NO: 1142 - RNA, 19 nt, Artificial Sequence
  Synthetic siNA antisense region
aaacaauucaccugccuca

SEQ ID NO: 1143 - RNA, 19 nt, Artificial Sequence
  Synthetic siNA antisense region
ccuccaccucccagguuca

SEQ ID NO: 1144 - RNA, 19 nt, Artificial Sequence
  Synthetic siNA antisense region
gaucucugcucacugcaac

SEQ ID NO: 1145 - RNA, 19 nt, Artificial Sequence
  Synthetic siNA antisense region
gcuagagugcaguggugug

SEQ ID NO: 1146 - RNA, 19 nt, Artificial Sequence
  Synthetic siNA antisense region
ucuugcucugucacccagg

SEQ ID NO: 1147 - RNA, 19 nt, Artificial Sequence
  Synthetic siNA antisense region
uuuguuuuuuagacagagu

SEQ ID NO: 1148 - RNA, 19 nt, Artificial Sequence
  Synthetic siNA antisense region
uguuuuguuuuguuuuguu

SEQ ID NO: 1149 - RNA, 19 nt, Artificial Sequence
  Synthetic siNA antisense region
aauauuaagagguuuuuuu

SEQ ID NO: 1150 - RNA, 19 nt, Artificial Sequence
  Synthetic siNA antisense region
agggaaugaugacuccaga

SEQ ID NO: 1151 - RNA, 19 nt, Artificial Sequence
  Synthetic siNA antisense region
agaggaaaaugcugucgaa

SEQ ID NO: 1152 - RNA, 19 nt, Artificial Sequence
  Synthetic siNA antisense region
uucuggggcuuucaaagca

SEQ ID NO: 1153 - RNA, 19 nt, Artificial Sequence
  Synthetic siNA antisense region
aucauggccaacacugauu

SEQ ID NO: 1154 - RNA, 19 nt, Artificial Sequence
  Synthetic siNA antisense region
gguuuuucuguaguuguca

SEQ ID NO: 1155 - RNA, 19 nt, Artificial Sequence
  Synthetic siNA antisense region
ggcaaagaagcugccucug

SEQ ID NO: 1156 - RNA, 19 nt, Artificial Sequence
  Synthetic siNA antisense region
auggcuuugaaaggucuug

SEQ ID NO: 1157 - RNA, 19 nt, Artificial Sequence
  Synthetic siNA antisense region
ugccccuaacagccuaaaa

SEQ ID NO: 1158 - RNA, 19 nt, Artificial Sequence
  Synthetic siNA antisense region
gagucauucuaccuccacu

SEQ ID NO: 1159 - RNA, 19 nt, Artificial Sequence
  Synthetic siNA antisense region
gaaacucuaauacccaagg

SEQ ID NO: 1160 - RNA, 19 nt, Artificial Sequence
  Synthetic siNA antisense region
guuagagacuucaugguug

SEQ ID NO: 1161 - RNA, 19 nt, Artificial Sequence
  Synthetic siNA antisense region
aggugaagaaaauacauug

SEQ ID NO: 1162 - RNA, 19 nt, Artificial Sequence
  Synthetic siNA antisense region
augcuacuugaguagcaga

SEQ ID NO: 1163 - RNA, 19 nt, Artificial Sequence
  Synthetic siNA antisense region
aaaccaaagacacaguaaa

SEQ ID NO: 1164 - RNA, 19 nt, Artificial Sequence
  Synthetic siNA antisense region
cacccgggggccuagcaca

SEQ ID NO: 1165 - RNA, 19 nt, Artificial Sequence
  Synthetic siNA antisense region
gaaggggucugugcuucac

SEQ ID NO: 1166 - RNA, 19 nt, Artificial Sequence
  Synthetic siNA antisense region
auagacuguaaaccccugg

SEQ ID NO: 1167 - RNA, 19 nt, Artificial Sequence
  Synthetic siNA antisense region
agaacugaggagucucaaa

SEQ ID NO: 1168 - RNA, 19 nt, Artificial Sequence
  Synthetic siNA antisense region
uuaaaaaaaaaaguggcaa

SEQ ID NO: 1169 - RNA, 19 nt, Artificial Sequence
  Synthetic siNA antisense region
aaaaaugacugguggagau

SEQ ID NO: 1170 - RNA, 19 nt, Artificial Sequence
  Synthetic siNA antisense region
gaggaguuaaaaggucuga

SEQ ID NO: 1171 - RNA, 19 nt, Artificial Sequence
  Synthetic siNA antisense region
gaaaucaguguuggaauug

SEQ ID NO: 1172 - RNA, 19 nt, Artificial Sequence
  Synthetic siNA antisense region
agggagaaugcaaaagggg

SEQ ID NO: 1173 - RNA, 19 nt, Artificial Sequence
  Synthetic siNA antisense region
gcuacaaggaagggaagga

SEQ ID NO: 1174 - RNA, 19 nt, Artificial Sequence
  Synthetic siNA antisense region
uccaaugaaagucaaaagg

SEQ ID NO: 1175 - RNA, 19 nt, Artificial Sequence
  Synthetic siNA antisense region
cagauuuacauccuaauuu

SEQ ID NO: 1176 - RNA, 19 nt, Artificial Sequence
  Synthetic siNA antisense region
uccuccaggucuccugagc

SEQ ID NO: 1177 - RNA, 19 nt, Artificial Sequence
  Synthetic siNA antisense region
augcuaauuauccucugcu

SEQ ID NO: 1178 - RNA, 19 nt, Artificial Sequence
  Synthetic siNA antisense region
acucacacuuaaccugaga

SEQ ID NO: 1179 - RNA, 19 nt, Artificial Sequence
  Synthetic siNA antisense region
gucauuguuucucagauua

SEQ ID NO: 1180 - RNA, 19 nt, Artificial Sequence
  Synthetic siNA antisense region
caaaauaugcaagaauuag

SEQ ID NO: 1181 - RNA, 19 nt, Artificial Sequence
  Synthetic siNA antisense region
acccucacauggaaguuac

SEQ ID NO: 1182 - RNA, 19 nt, Artificial Sequence
  Synthetic siNA antisense region
caaauaucaaugcugaaaa

SEQ ID NO: 1183 - RNA, 19 nt, Artificial Sequence
  Synthetic siNA antisense region
cucuguuuagaaaaugcac

SEQ ID NO: 1184 - RNA, 19 nt, Artificial Sequence
  Synthetic siNA antisense region
gugaagauaccaccucauc

SEQ ID NO: 1185 - RNA, 19 nt, Artificial Sequence
  Synthetic siNA antisense region
cgaauaccaauguucuacg

SEQ ID NO: 1186 - RNA, 19 nt, Artificial Sequence
  Synthetic siNA antisense region
uauucuuuuuuucucaagc

SEQ ID NO: 1187 - RNA, 19 nt, Artificial Sequence
  Synthetic siNA antisense region
aagagaaauagguucaacu

SEQ ID NO: 1188 - RNA, 19 nt, Artificial Sequence
  Synthetic siNA antisense region
ggacccaucuuguaaagaa

SEQ ID NO: 1189 - RNA, 19 nt, Artificial Sequence
  Synthetic siNA antisense region
agagaaaagaggaauccug

SEQ ID NO: 1190 - RNA, 19 nt, Artificial Sequence
  Synthetic siNA antisense region
uaauuaaucauuuauggca

SEQ ID NO: 1191 - RNA, 19 nt, Artificial Sequence
  Synthetic siNA antisense region
uaagacacaaaagcuauuu

SEQ ID NO: 1192 - RNA, 19 nt, Artificial Sequence
  Synthetic siNA antisense region
gcuggcuggcuaccaaugu

SEQ ID NO: 1193 - RNA, 19 nt, Artificial Sequence
  Synthetic siNA antisense region
agcauaaacagagccuugg

SEQ ID NO: 1194 - RNA, 19 nt, Artificial Sequence
  Synthetic siNA antisense region
caauauaugccccccaaaa

SEQ ID NO: 1195 - RNA, 19 nt, Artificial Sequence
  Synthetic siNA antisense region
auaggugagaauggaaccc

SEQ ID NO: 1196 - RNA, 19 nt, Artificial Sequence
  Synthetic siNA antisense region
uacggauauguugugugga

SEQ ID NO: 1197 - RNA, 19 nt, Artificial Sequence
  Synthetic siNA antisense region
aagaguagaggggauauau

SEQ ID NO: 1198 - RNA, 19 nt, Artificial Sequence
  Synthetic siNA antisense region
uuuaaauuugggggaagua

SEQ ID NO: 1199 - RNA, 19 nt, Artificial Sequence
  Synthetic siNA antisense region
ucucauuucccauacuucu

SEQ ID NO: 1200 - RNA, 19 nt, Artificial Sequence
  Synthetic siNA antisense region
uggggugggggaaaugccu

SEQ ID NO: 1201 - RNA, 19 nt, Artificial Sequence
  Synthetic siNA antisense region
ugugugugaggagagaaau

SEQ ID NO: 1202 - RNA, 19 nt, Artificial Sequence
  Synthetic siNA antisense region
cuaccaguaauaugagucu

SEQ ID NO: 1203 - RNA, 19 nt, Artificial Sequence
  Synthetic siNA antisense region
aauaaaguucucaaguucc

SEQ ID NO: 1204 - RNA, 19 nt, Artificial Sequence
  Synthetic siNA antisense region
auguuugaacaacuuggaa

SEQ ID NO: 1205 - RNA, 19 nt, Artificial Sequence
  Synthetic siNA antisense region
uauuaauaugauugguaaa

SEQ ID NO: 1206 - RNA, 19 nt, Artificial Sequence
  Synthetic siNA antisense region
uugcaaauagcaucauugu

SEQ ID NO: 1207 - RNA, 19 nt, Artificial Sequence
  Synthetic siNA antisense region
cuccccuaggagcaggaau

SEQ ID NO: 1208 - RNA, 19 nt, Artificial Sequence
  Synthetic siNA antisense region
gaggguuucuuaucucccc

SEQ ID NO: 1209 - RNA, 19 nt, Artificial Sequence
  Synthetic siNA antisense region
cccaaaccuguagagagug

SEQ ID NO: 1210 - RNA, 19 nt, Artificial Sequence
  Synthetic siNA antisense region
agcagguugccacuuguac

SEQ ID NO: 1211 - RNA, 19 nt, Artificial Sequence
  Synthetic siNA antisense region
cuucuacacggccauggaa

SEQ ID NO: 1212 - RNA, 19 nt, Artificial Sequence
  Synthetic siNA antisense region
agaagccagggcaccaugc

SEQ ID NO: 1213 - RNA, 19 nt, Artificial Sequence
  Synthetic siNA antisense region
gaaccccagcuuccucaga

SEQ ID NO: 1214 - RNA, 19 nt, Artificial Sequence
  Synthetic siNA antisense region
uacaucugccauugucaug

SEQ ID NO: 1215 - RNA, 19 nt, Artificial Sequence
  Synthetic siNA antisense region
ugacuucaagaauaacuuu

SEQ ID NO: 1216 - RNA, 19 nt, Artificial Sequence
  Synthetic siNA antisense region
ugucucccagccucaaucu

SEQ ID NO: 1217 - RNA, 19 nt, Artificial Sequence
  Synthetic siNA antisense region
uagaacaucuacuacggcu

SEQ ID NO: 1218 - RNA, 19 nt, Artificial Sequence
  Synthetic siNA antisense region
gagaacagcagaacaaagu

SEQ ID NO: 1219 - RNA, 19 nt, Artificial Sequence
  Synthetic siNA antisense region
aaccaaauauucuuucuag

SEQ ID NO: 1220 - RNA, 19 nt, Artificial Sequence
  Synthetic siNA antisense region
cucauuccuauacaggaaa

SEQ ID NO: 1221 - RNA, 19 nt, Artificial Sequence
  Synthetic siNA antisense region
accuggaaaggaauuaauc

SEQ ID NO: 1222 - RNA, 19 nt, Artificial Sequence
  Synthetic siNA antisense region
uucccagaauuauaaaaua

SEQ ID NO: 1223 - RNA, 19 nt, Artificial Sequence
  Synthetic siNA antisense region
gggaggcauggguuuugcu

SEQ ID NO: 1224 - RNA, 19 nt, Artificial Sequence
  Synthetic siNA antisense region
acaguaaaaauggcuaggg

SEQ ID NO: 1225 - RNA, 19 nt, Artificial Sequence
  Synthetic siNA antisense region
ggccaucuaaauaggauaa

SEQ ID NO: 1226 - RNA, 19 nt, Artificial Sequence
  Synthetic siNA antisense region
ucacagcauccucuucaug

SEQ ID NO: 1227 - RNA, 19 nt, Artificial Sequence
  Synthetic siNA antisense region
caauguuuguugggaauuu

SEQ ID NO: 1228 - RNA, 19 nt, Artificial Sequence
  Synthetic siNA antisense region
cugcaugacugucagcauc

SEQ ID NO: 1229 - RNA, 19 nt, Artificial Sequence
  Synthetic siNA antisense region
cacuuccccacucccagac

SEQ ID NO: 1230 - RNA, 19 nt, Artificial Sequence
  Synthetic siNA antisense region
aggaugggaacaaaagauc

SEQ ID NO: 1231 - RNA, 19 nt, Artificial Sequence
  Synthetic siNA antisense region
uuuuacugcuaaaagaaga

SEQ ID NO: 1232 - RNA, 19 nt, Artificial Sequence
  Synthetic siNA antisense region
ucccuuuucccucagcuau

SEQ ID NO: 1233 - RNA, 19 nt, Artificial Sequence
  Synthetic siNA antisense region
ccauaacuuccuuuucccu

SEQ ID NO: 1234 - RNA, 19 nt, Artificial Sequence
  Synthetic siNA antisense region
caaccaccacagguauucc

SEQ ID NO: 1235 - RNA, 19 nt, Artificial Sequence
  Synthetic siNA antisense region
cccaagaccuagggaucac

SEQ ID NO: 1236 - RNA, 19 nt, Artificial Sequence
  Synthetic siNA antisense region
cagacaccuccaagagcuc

SEQ ID NO: 1237 - RNA, 19 nt, Artificial Sequence
  Synthetic siNA antisense region
augggaaauccacugauac

SEQ ID NO: 1238 - RNA, 19 nt, Artificial Sequence
  Synthetic siNA antisense region
acuaauuucccacagggga

SEQ ID NO: 1239 - RNA, 19 nt, Artificial Sequence
  Synthetic siNA antisense region
aaaacaguaaaugagccua

SEQ ID NO: 1240 - RNA, 19 nt, Artificial Sequence
  Synthetic siNA antisense region
uccacauaggcuagaccua

SEQ ID NO: 1241 - RNA, 19 nt, Artificial Sequence
  Synthetic siNA antisense region
agguauguuaggaaaaaau

SEQ ID NO: 1242 - RNA, 19 nt, Artificial Sequence
  Synthetic siNA antisense region
cugacacuggguuugcuua

SEQ ID NO: 1243 - RNA, 19 nt, Artificial Sequence
  Synthetic siNA antisense region
agaauaagaauuaccaucc

SEQ ID NO: 1244 - RNA, 19 nt, Artificial Sequence
  Synthetic siNA antisense region
aaaacuuaacugaacgaaa

SEQ ID NO: 1245 - RNA, 19 nt, Artificial Sequence
  Synthetic siNA antisense region
agugcccagaugaagggaa

SEQ ID NO: 1246 - RNA, 19 nt, Artificial Sequence
  Synthetic siNA antisense region
uguuucacauaucccuuca

SEQ ID NO: 1247 - RNA, 19 nt, Artificial Sequence
  Synthetic siNA antisense region
uaccaaaaauguuaacauu

SEQ ID NO: 1248 - RNA, 19 nt, Artificial Sequence
  Synthetic siNA antisense region
caaucccugguugaagacu

SEQ ID NO: 1249 - RNA, 19 nt, Artificial Sequence
  Synthetic siNA antisense region
uaagaaguuaaacagaaac

SEQ ID NO: 1250 - RNA, 19 nt, Artificial Sequence
  Synthetic siNA antisense region
uuuacucaagcuuuccuau

SEQ ID NO: 1251 - RNA, 19 nt, Artificial Sequence
  Synthetic siNA antisense region
caaaaagacaauauuuauu

SEQ ID NO: 1252 - RNA, 19 nt, Artificial Sequence
  Synthetic siNA antisense region
acauacaaaaagacaauau

SEQ ID NO: 1253 - RNA, 23 nt, Artificial Sequence
  Synthetic Target Sequence/siNA sense region
acaccacagcugauuucuuccug

SEQ ID NO: 1254 - RNA, 23 nt, Artificial Sequence
  Synthetic Target Sequence/siNA sense region
auuucuuccugaccacuaugccc

SEQ ID NO: 1255 - RNA, 23 nt, Artificial Sequence
  Synthetic Target Sequence/siNA sense region
cugaccacuaugcccacugacuc

SEQ ID NO: 1256 - RNA, 23 nt, Artificial Sequence
  Synthetic Target Sequence/siNA sense region
ugacucccucaguguuuccacuc

SEQ ID NO: 1257 - RNA, 23 nt, Artificial Sequence
  Synthetic Target Sequence/siNA sense region
ccaaccucacucugcauuauugg

SEQ ID NO: 1258 - RNA, 23 nt, Artificial Sequence
  Synthetic Target Sequence/siNA sense region
ugauaaaguccagaagugcagcc

SEQ ID NO: 1259 - RNA, 23 nt, Artificial Sequence
  Synthetic Target Sequence/siNA sense region
gauaaaguccagaagugcagcca

SEQ ID NO: 1260 - RNA, 23 nt, Artificial Sequence
  Synthetic Target Sequence/siNA sense region
aaucacuucuggcugucaguugc

SEQ ID NO: 1261 - RNA, 3 nt, Artificial Sequence
  Synthetic Target Sequence/siNA sense region
aaa

SEQ ID NO: 1262 - RNA, 3 nt, Artificial Sequence
  Synthetic Target Sequence/siNA sense region
aaa

SEQ ID NO: 1263 - RNA, 3 nt, Artificial Sequence
  Synthetic Target Sequence/siNA sense region
aaa

SEQ ID NO: 1264 - RNA, 3 nt, Artificial Sequence
  Synthetic Target Sequence/siNA sense region
aaa

SEQ ID NO: 1265 - RNA, 3 nt, Artificial Sequence
  Synthetic Target Sequence/siNA sense region
aaa

SEQ ID NO: 1266 - RNA, 3 nt, Artificial Sequence
  Synthetic Target Sequence/siNA sense region
aaa

SEQ ID NO: 1267 - RNA, 3 nt, Artificial Sequence
  Synthetic Target Sequence/siNA sense region
aaa

SEQ ID NO: 1268 - RNA, 3 nt, Artificial Sequence
  Synthetic Target Sequence/siNA sense region
aaa

SEQ ID NO: 1269 - RNA, 23 nt, Artificial Sequence
  Synthetic Target Sequence/siNA sense region
cagccucacagagcagaagacuc

SEQ ID NO: 1270 - RNA, 23 nt, Artificial Sequence
  Synthetic Target Sequence/siNA sense region
gccucacagagcagaagacucug

SEQ ID NO: 1271 - RNA, 23 nt, Artificial Sequence
  Synthetic Target Sequence/siNA sense region
ccgaguugaccguaacagacauc

SEQ ID NO: 1272 - RNA, 23 nt, Artificial Sequence
  Synthetic Target Sequence/siNA sense region
cguaacagacaucuuugcugccu

SEQ ID NO: 1273 - RNA, 23 nt, Artificial Sequence
  Synthetic Target Sequence/siNA sense region
gccuccaagaacacaacugagaa

SEQ ID NO: 1274 - RNA, 23 nt, Artificial Sequence
  Synthetic Target Sequence/siNA sense region
ucuacagccaccaugagaaggac

SEQ ID NO: 1275 - RNA, 23 nt, Artificial Sequence
  Synthetic Target Sequence/siNA sense region
uugaauuccuguccugugaagga

SEQ ID NO: 1276 - RNA, 23 nt, Artificial Sequence
  Synthetic Target Sequence/siNA sense region
gaaggaagccaaccagaguacgu

SEQ ID NO: 1277 - RNA, 23 nt, Artificial Sequence
  Synthetic Target Sequence/siNA sense region
cuauacacuggaccugugggcug

SEQ ID NO: 1278 - RNA, 23 nt, Artificial Sequence
  Synthetic Target Sequence/siNA sense region
ccaggaaaccugacaguucacac

SEQ ID NO: 1279 - RNA, 23 nt, Artificial Sequence
  Synthetic Target Sequence/siNA sense region
agcacaacaugaaaagggaugaa

SEQ ID NO: 1280 - RNA, 23 nt, Artificial Sequence
  Synthetic Target Sequence/siNA sense region
gcacaacaugaaaagggaugaag

SEQ ID NO: 1281 - RNA, 23 nt, Artificial Sequence
  Synthetic Target Sequence/siNA sense region
aagggaugaagauccucacaagg

SEQ ID NO: 1282 - RNA, 23 nt, Artificial Sequence
  Synthetic Target Sequence/siNA sense region
uugggaaaucgaugagaaauuga

SEQ ID NO: 1283 - RNA, 23 nt, Artificial Sequence
  Synthetic Target Sequence/siNA sense region
ugggaaaucgaugagaaauugaa

SEQ ID NO: 1284 - RNA, 23 nt, Artificial Sequence
  Synthetic Target Sequence/siNA sense region
ucauugccuagaggugcucauuc

SEQ ID NO: 1285 - RNA, 23 nt, Artificial Sequence
  Synthetic Target Sequence/siNA sense region
cccaguuuguaaaggaccugcuc

SEQ ID NO: 1286 - RNA, 23 nt, Artificial Sequence
  Synthetic Target Sequence/siNA sense region
cacuucacacacaggcaacugag

SEQ ID NO: 1287 - RNA, 23 nt, Artificial Sequence
  Synthetic Target Sequence/siNA sense region
ucaggcacacuucuucuuggucu

SEQ ID NO: 1288 - RNA, 23 nt, Artificial Sequence
  Synthetic Target Sequence/siNA sense region
aagacuguggcugcuagcacuug

SEQ ID NO: 1289 - RNA, 23 nt, Artificial Sequence
  Synthetic Target Sequence/siNA sense region
agcacuaaagcaguggacaccag

SEQ ID NO: 1290 - RNA, 23 nt, Artificial Sequence
  Synthetic Target Sequence/siNA sense region
cacuaaagcaguggacaccagga

SEQ ID NO: 1291 - RNA, 23 nt, Artificial Sequence
  Synthetic Target Sequence/siNA sense region
uaaagcaguggacaccaggaguc

SEQ ID NO: 1292 - RNA, 23 nt, Artificial Sequence
  Synthetic Target Sequence/siNA sense region
agaaggguaccuugaacacuggg

SEQ ID NO: 1293 - RNA, 23 nt, Artificial Sequence
  Synthetic Target Sequence/siNA sense region
uauuguguguuauuuaaaugagu

SEQ ID NO: 1294 - RNA, 23 nt, Artificial Sequence
  Synthetic Target Sequence/siNA sense region
auuguguguuauuuaaaugagug

SEQ ID NO: 1295 - RNA, 23 nt, Artificial Sequence
  Synthetic Target Sequence/siNA sense region
uuguguguuauuuaaaugagugu

SEQ ID NO: 1296 - RNA, 23 nt, Artificial Sequence
  Synthetic Target Sequence/siNA sense region
uuauuguguguuauuuaaaugag

SEQ ID NO: 1297 - RNA, 23 nt, Artificial Sequence
  Synthetic Target Sequence/siNA sense region
ugcaauggcagcaugguauggag

SEQ ID NO: 1298 - RNA, 23 nt, Artificial Sequence
  Synthetic Target Sequence/siNA sense region
gcaauggcagcaugguauggagc

SEQ ID NO: 1299 - RNA, 23 nt, Artificial Sequence
  Synthetic Target Sequence/siNA sense region
caauggcagcaugguauggagca

SEQ ID NO: 1300 - RNA, 23 nt, Artificial Sequence
  Synthetic Target Sequence/siNA sense region
uuauuauuguguguuauuuaaau

SEQ ID NO: 1301 - RNA, 23 nt, Artificial Sequence
  Synthetic Target Sequence/siNA sense region
uauuauuguguguuauuuaaaug

SEQ ID NO: 1302 - RNA, 23 nt, Artificial Sequence
  Synthetic Target Sequence/siNA sense region
auuauuguguguuauuuaaauga

SEQ ID NO: 1303 - RNA, 23 nt, Artificial Sequence
  Synthetic Target Sequence/siNA sense region
aaggugauccugagucugcugug

SEQ ID NO: 1304 - RNA, 23 nt, Artificial Sequence
  Synthetic Target Sequence/siNA sense region
uggucaaggauaaugcaggaaaa

SEQ ID NO: 1305 - RNA, 23 nt, Artificial Sequence
  Synthetic Target Sequence/siNA sense region
cguccaagaggcuaaaugugaga

SEQ ID NO: 1306 - RNA, 23 nt, Artificial Sequence
  Synthetic Target Sequence/siNA sense region
ggaaaccgacucuguagugcuga

SEQ ID NO: 1307 - RNA, 23 nt, Artificial Sequence
  Synthetic Target Sequence/siNA sense region
ugaagaaagccucucagugaugg

SEQ ID NO: 1308 - RNA, 23 nt, Artificial Sequence
  Synthetic Target Sequence/siNA sense region
acugcaccauuuaaaaacaggca

SEQ ID NO: 1309 - RNA, 23 nt, Artificial Sequence
  Synthetic Target Sequence/siNA sense region
cagcauuuuccucugcuuugaaa

SEQ ID NO: 1310 - RNA, 23 nt, Artificial Sequence
  Synthetic Target Sequence/siNA sense region
ccaagaccuuucaaagccauuuu

SEQ ID NO: 1311 - DNA, 21 bp, Artificial Sequence
  Synthetic siNA sense region
  misc_feature (1)..(19): ribonucleotide/modified as described
accacagcugauuucuucctt

SEQ ID NO: 1312 - DNA, 21 bp, Artificial Sequence
  Synthetic siNA sense region
  misc_feature (1)..(19): ribonucleotide/modified as described
uucuuccugaccacuaugctt

SEQ ID NO: 1313 - DNA, 21 bp, Artificial Sequence
  Synthetic siNA sense region
  misc_feature (1)..(19): ribonucleotide/modified as described
gaccacuaugcccacugactt

SEQ ID NO: 1314 - DNA, 21 bp, Artificial Sequence
  Synthetic siNA sense region
  misc_feature (1)..(19): ribonucleotide/modified as described
acucccucaguguuuccactt

SEQ ID NO: 1315 - DNA, 21 bp, Artificial Sequence
  Synthetic siNA sense region
  misc_feature (1)..(19): ribonucleotide/modified as described
aaccucacucugcauuauutt

SEQ ID NO: 1316 - DNA, 21 bp, Artificial Sequence
  Synthetic siNA sense region
  misc_feature (1)..(19): ribonucleotide/modified as described
auaaaguccagaagugcagtt

SEQ ID NO: 1317 - DNA, 21 bp, Artificial Sequence
  Synthetic siNA sense region
  misc_feature (1)..(19): ribonucleotide/modified as described
uaaaguccagaagugcagctt

SEQ ID NO: 1318 - DNA, 21 bp, Artificial Sequence
  Synthetic siNA sense region
  misc_feature (1)..(19): ribonucleotide/modified as described
ucacuucuggcugucaguutt

SEQ ID NO: 1319 - DNA, 21 bp, Artificial Sequence
  Synthetic siNA antisense region
  misc_feature (1)..(19): ribonucleotide/modified as described
ggaagaaaucagcuguggutt

SEQ ID NO: 1320 - DNA, 21 bp, Artificial Sequence
  Synthetic siNA antisense region
  misc_feature (1)..(19): ribonucleotide/modified as described
gcauaguggucaggaagaatt

SEQ ID NO: 1321 - DNA, 21 bp, Artificial Sequence
  Synthetic siNA antisense region
  misc_feature (1)..(19): ribonucleotide/modified as described
gucagugggcauagugguctt

SEQ ID NO: 1322 - DNA, 21 bp, Artificial Sequence
  Synthetic siNA antisense region
  misc_feature (1)..(19): ribonucleotide/modified as described
guggaaacacugagggagutt

SEQ ID NO: 1323 - DNA, 21 bp, Artificial Sequence
  Synthetic siNA antisense region
  misc_feature (1)..(19): ribonucleotide/modified as described
aauaaugcagagugagguutt

SEQ ID NO: 1324 - DNA, 21 bp, Artificial Sequence
  Synthetic siNA antisense region
  misc_feature (1)..(19): ribonucleotide/modified as described
cugcacuucuggacuuuautt

SEQ ID NO: 1325 - DNA, 21 bp, Artificial Sequence
  Synthetic siNA antisense region
  misc_feature (1)..(19): ribonucleotide/modified as described
gcugcacuucuggacuuuatt

SEQ ID NO: 1326 - DNA, 21 bp, Artificial Sequence
  Synthetic siNA antisense region
  misc_feature (1)..(19): ribonucleotide/modified as described
aacugacagccagaagugatt

SEQ ID NO: 1327 - DNA, 21 bp, Artificial Sequence
  Synthetic siNA sense region
  misc_feature (1)..(1): 5'-3 attached terminal deoxyabasic moiety
  misc_feature (2)..(3): 2'-deoxy-2'-fluoro
  misc_feature (5)..(5): 2'-deoxy-2'-fluoro
  misc_feature (8)..(9): 2'-deoxy-2'-fluoro
  misc_feature (12)..(19): 2'-deoxy-2'-fluoro
  misc_feature (21)..(21): 3'-3 attached terminal deoxyabasic moiety
  misc_feature (1)..(19): ribonucleotide/modified as described
accacagcugauuucuucctt

SEQ ID NO: 1328 - DNA, 21 bp, Artificial Sequence
  Synthetic siNA sense region
  misc_feature (1)..(1): 5'-3 attached terminal deoxyabasic moiety
  misc_feature (1)..(8): 2'-deoxy-2'-fluoro
  misc_feature (11)..(12): 2'-deoxy-2'-fluoro
  misc_feature (14)..(15): 2'-deoxy-2'-fluoro
  misc_feature (17)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uucuuccugaccacuaugctt

SEQ ID NO: 1329 - DNA, 21 bp, Artificial Sequence
  Synthetic siNA sense region
  misc_feature (1)..(1): 5'-3 attached terminal deoxyabasic moiety
  misc_feature (3)..(4): 2'-deoxy-2'-fluoro
  misc_feature (6)..(7): 2'-deoxy-2'-fluoro
  misc_feature (9)..(9): 2'-deoxy-2'-fluoro
  misc_feature (11)..(13): 2'-deoxy-2'-fluoro
  misc_feature (15)..(16): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gaccacuaugcccacugactt

SEQ ID NO: 1330 - DNA, 21 bp, Artificial Sequence
  Synthetic siNA sense region
  misc_feature (1)..(1): 5'-3 attached terminal deoxyabasic moiety
  misc_feature (2)..(8): 2'-deoxy-2'-fluoro
  misc_feature (11)..(11): 2'-deoxy-2'-fluoro
  misc_feature (13)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
acucccucaguguuuccactt

SEQ ID NO: 1331 - DNA, 21 bp, Artificial Sequence
  Synthetic siNA sense region
  misc_feature (1)..(1): 5'-3 attached terminal deoxyabasic moiety
  misc_feature (3)..(6): 2'-deoxy-2'-fluoro
  misc_feature (8)..(11): 2'-deoxy-2'-fluoro
  misc_feature (13)..(13): 2'-deoxy-2'-fluoro
  misc_feature (15)..(16): 2'-deoxy-2'-fluoro
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
aaccucacucugcauuauutt

SEQ ID NO: 1332 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (7)..(9): 2'-deoxy-2'-fluoro
  misc_feature (15)..(15): 2'-deoxy-2'-fluoro
  misc_feature (17)..(17): 2'-deoxy-2'-fluoro
  misc_feature (21)..(21): 3'-3 attached terminal deoxyabasic moiety
  misc_feature (1)..(19): ribonucleotide/modified as described
auaaaguccagaagugcagtt

SEQ ID NO: 1333 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (6)..(8): 2'-deoxy-2'-fluoro
  misc_feature (14)..(14): 2'-deoxy-2'-fluoro
  misc_feature (16)..(16): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uaaaguccagaagugcagctt

SEQ ID NO: 1334 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (4)..(8): 2'-deoxy-2'-fluoro
  misc_feature (11)..(12): 2'-deoxy-2'-fluoro
  misc_feature (14)..(15): 2'-deoxy-2'-fluoro
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
ucacuucuggcugucaguutt

SEQ ID NO: 1335 - DNA, 21 bp, Artificial Sequence
  Synthetic siNA antisense region
  misc_feature (9)..(10): 2'-deoxy-2'-fluoro
  misc_feature (13)..(14): 2'-deoxy-2'-fluoro
  misc_feature (16)..(16): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
ggaagaaaucagcuguggutt

SEQ ID NO: 1336 - DNA, 21 bp, Artificial Sequence
  Synthetic siNA antisense region
  misc_feature (2)..(2): 2'-deoxy-2'-fluoro
  misc_feature (4)..(4): 2'-deoxy-2'-fluoro
  misc_feature (7)..(7): 2'-deoxy-2'-fluoro
  misc_feature (10)..(11): 2'-deoxy-2'-fluoro
  misc_feature (20)..(20): Phosphorothioate 3'-Internucleotide Linkage
  misc_feature (1)..(19): ribonucleotide/modified as described
gcauaguggucaggaagaatt

SEQ ID NO: 1337 - DNA, 21 bp, Artificial Sequence
  Synthetic siNA antisense region
  misc_feature (2)..(3): 2'-deoxy-2'-fluoro
  misc_feature (6)..(6): 2'-deoxy-2'-fluoro
  misc_feature (10)..(10): 2'-deoxy-2'-fluoro
  misc_feature (12)..(12): 2'-deoxy-2'-fluoro
  misc_feature (15)..(15): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (1)..(19): ribonucleotide/modified as described
gucagugggcauagugguctt

SEQ ID NO: 1338 - DNA, 21 bp, Artificial Sequence
  Synthetic siNA antisense region
  misc_feature (2)..(2): 2'-deoxy-2'-fluoro
  misc_feature (8)..(8): 2'-deoxy-2'-fluoro
  misc_feature (10)..(11): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
guggaaacacugagggagutt

SEQ ID NO: 1339 - DNA, 21 bp, Artificial Sequence
  Synthetic siNA antisense region
  misc_feature (3)..(3): 2'-deoxy-2'-fluoro
  misc_feature (6)..(6): 2'-deoxy-2'-fluoro
  misc_feature (8)..(8): 2'-deoxy-2'-fluoro
  misc_feature (13)..(13): 2'-deoxy-2'-fluoro
  misc_feature (18)..(19): 2'-deoxy-2'-fluoro
  misc_feature (20)..(20): Phosphorothioate 3'-Internucleotide Linkage
  misc_feature (1)..(19): ribonucleotide/modified as described
aauaaugcagagugagguutt

SEQ ID NO: 1340 - DNA, 21 bp, Artificial Sequence
  Synthetic siNA antisense region
  misc_feature (1)..(2): 2'-deoxy-2'-fluoro
  misc_feature (4)..(4): 2'-deoxy-2'-fluoro
  misc_feature (6)..(10): 2'-deoxy-2'-fluoro
  misc_feature (14)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
cugcacuucuggacuuuautt

SEQ ID NO: 1341 - DNA, 21 bp, Artificial Sequence
  Synthetic siNA antisense region
  misc_feature (2)..(3): 2'-deoxy-2'-fluoro
  misc_feature (5)..(5): 2'-deoxy-2'-fluoro
  misc_feature (7)..(11): 2'-deoxy-2'-fluoro
  misc_feature (15)..(18): 2'-deoxy-2'-fluoro
  misc_feature (20)..(20): Phosphorothioate 3'-Internucleotide Linkage
  misc_feature (1)..(19): ribonucleotide/modified as described
gcugcacuucuggacuuuatt

SEQ ID NO: 1342 - DNA, 21 bp, Artificial Sequence
  Synthetic siNA antisense region
  misc_feature (3)..(4): 2'-deoxy-2'-fluoro
  misc_feature (7)..(7): 2'-deoxy-2'-fluoro
  misc_feature (10)..(11): 2'-deoxy-2'-fluoro
  misc_feature (17)..(17): 2'-deoxy-2'-fluoro
  misc_feature (20)..(20): Phosphorothioate 3'-Internucleotide Linkage
  misc_feature (1)..(19): ribonucleotide/modified as described
aacugacagccagaagugatt

SEQ ID NO: 1343 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(9): 2'-deoxy-2'-fluoro
  misc_feature (10)..(11): 2'-deoxy
  misc_feature (12)..(19): 2'-deoxy-2'-fluoro
  misc_feature (21)..(21): 3'-3 attached terminal deoxyabasic moiety
  misc_feature (1)..(19): ribonucleotide/modified as described
accacagcugauuucuucctt

SEQ ID NO: 1344 - DNA, 21 bp, Artificial Sequence
  Synthetic siNA sense region
  misc_feature (1)..(1): 5'-3 attached terminal deoxyabasic moiety
  misc_feature (1)..(8): 2'-deoxy-2'-fluoro
  misc_feature (9)..(10): 2'-deoxy
  misc_feature (11)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uucuuccugaccacuaugctt

SEQ ID NO: 1345 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy
  misc_feature (3)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(13): 2'-deoxy-2'-fluoro
  misc_feature (14)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gaccacuaugcccacugactt

SEQ ID NO: 1346 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(8): 2'-deoxy-2'-fluoro
  misc_feature (9)..(10): 2'-deoxy
  misc_feature (11)..(11): 2'-deoxy-2'-fluoro
  misc_feature (12)..(12): 2'-deoxy
  misc_feature (13)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
acucccucaguguuuccactt

SEQ ID NO: 1347 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy
  misc_feature (3)..(6): 2'-deoxy-2'-fluoro
  misc_feature (7)..(7): 2'-deoxy
  misc_feature (8)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
aaccucacucugcauuauutt

SEQ ID NO: 1348 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(2): 2'-deoxy-2'-fluoro
  misc_feature (3)..(6): 2'-deoxy
  misc_feature (7)..(9): 2'-deoxy-2'-fluoro
  misc_feature (10)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (21)..(21): 3'-3 attached terminal deoxyabasic moiety
  misc_feature (1)..(19): ribonucleotide/modified as described
auaaaguccagaagugcagtt

SEQ ID NO: 1349 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(5): 2'-deoxy
  misc_feature (6)..(8): 2'-deoxy-2'-fluoro
  misc_feature (9)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uaaaguccagaagugcagctt

SEQ ID NO: 1350 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (3)..(3): 2'-deoxy
  misc_feature (4)..(8): 2'-deoxy-2'-fluoro
  misc_feature (9)..(10): 2'-deoxy
  misc_feature (11)..(12): 2'-deoxy-2'-fluoro
  misc_feature (13)..(13): 2'-deoxy
  misc_feature (14)..(15): 2'-deoxy-2'-fluoro
  misc_feature (16)..(17): 2'-deoxy
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
ucacuucuggcugucaguutt

SEQ ID NO: 1351 - DNA, 21 bp, Artificial Sequence
  Synthetic siNA antisense region
  misc_feature (1)..(8): 2'-deoxy
  misc_feature (9)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
ggaagaaaucagcuguggutt

SEQ ID NO: 1352 - DNA, 21 bp, Artificial Sequence
  Synthetic siNA antisense region
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(7): 2'-deoxy-2'-fluoro
  misc_feature (8)..(9): 2'-deoxy
  misc_feature (10)..(11): 2'-deoxy-2'-fluoro
  misc_feature (12)..(19): 2'-deoxy
  misc_feature (20)..(20): Phosphorothioate 3'-Internucleotide Linkage
  misc_feature (1)..(19): ribonucleotide/modified as described
gcauaguggucaggaagaatt

SEQ ID NO: 1353 - DNA, 21 bp, Artificial Sequence
  Synthetic siNA antisense region
  misc_feature (1)..(1): 2'-deoxy
  misc_feature (2)..(3): 2'-deoxy-2'-fluoro
  misc_feature (4)..(5): 2'-deoxy
  misc_feature (6)..(6): 2'-deoxy-2'-fluoro
  misc_feature (7)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(17): 2'-deoxy
  misc_feature (18)..(19): 2'-deoxy-2'-fluoro
  misc_feature (20)..(20): Phosphorothioate 3'-Internucleotide Linkage
  misc_feature (1)..(19): ribonucleotide/modified as described
gucagugggcauagugguctt

SEQ ID NO: 1354 - DNA, 21 bp, Artificial Sequence
  Synthetic siNA antisense region
  misc_feature (1)..(1): 2'-deoxy
  misc_feature (2)..(2): 2'-deoxy-2'-fluoro
  misc_feature (3)..(7): 2'-deoxy
  misc_feature (8)..(8): 2'-deoxy-2'-fluoro
  misc_feature (9)..(9): 2'-deoxy
  misc_feature (10)..(11): 2'-deoxy-2'-fluoro
  misc_feature (12)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
guggaaacacugagggagutt

SEQ ID NO: 1355 - DNA, 21 bp, Artificial Sequence
  Synthetic siNA antisense region
  misc_feature (1)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(12): 2'-deoxy
  misc_feature (13)..(13): 2'-deoxy-2'-fluoro
  misc_feature (14)..(17): 2'-deoxy
  misc_feature (18)..(19): 2'-deoxy-2'-fluoro
  misc_feature (20)..(20): Phosphorothioate 3'-Internucleotide Linkage
  misc_feature (1)..(19): ribonucleotide/modified as described
aauaaugcagagugagguutt

SEQ ID NO: 1356 - DNA, 21 bp, Artificial Sequence
  Synthetic siNA antisense region
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(10): 2'-deoxy-2'-fluoro
  misc_feature (11)..(13): 2'-deoxy
  misc_feature (14)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
cugcacuucuggacuuuautt

SEQ ID NO: 1357 - DNA, 21 bp, Artificial Sequence
  Synthetic siNA antisense region
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(11): 2'-deoxy-2'-fluoro
  misc_feature (12)..(14): 2'-deoxy
  misc_feature (15)..(18): 2'-deoxy-2'-fluoro
  misc_feature (19)..(19): 2'-deoxy
  misc_feature (20)..(20): Phosphorothioate 3'-Internucleotide Linkage
gcugcacuucuggacuuuatt

SEQ ID NO: 1358 - DNA, 21 bp, Artificial Sequence
  Synthetic siNA antisense region
  misc_feature (1)..(2): 2'-deoxy
  misc_feature (3)..(4): 2'-deoxy-2'-fluoro
  misc_feature (5)..(6): 2'-deoxy
  misc_feature (7)..(7): 2'-deoxy-2'-fluoro
  misc_feature (8)..(9): 2'-deoxy
  misc_feature (10)..(11): 2'-deoxy-2'-fluoro
  misc_feature (12)..(16): 2'-deoxy
  misc_feature (17)..(17): 2'-deoxy-2'-fluoro
  misc_feature (18)..(19): 2'-deoxy
  misc_feature (20)..(20): Phosphorothioate 3'-Internucleotide Linkage
  misc_feature (1)..(19): ribonucleotide/modified as described
aacugacagccagaagugatt

SEQ ID NO: 1359 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(3): 2'-deoxy-2'-fluoro
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(11): 2'-O-methyl
  misc_feature (12)..(19): 2'-deoxy-2'-fluoro
  misc_feature (21)..(21): 3'-3 attached terminal deoxyabasic moiety
  misc_feature (1)..(19): ribonucleotide/modified as described
accacagcugauuucuucctt

SEQ ID NO: 1360 - DNA, 21 bp, Artificial Sequence
  Synthetic siNA sense region
  misc_feature (1)..(1): 5'-3 attached terminal deoxyabasic moiety
  misc_feature (1)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uucuuccugaccacuaugctt

SEQ ID NO: 1361 - DNA, 21 bp, Artificial Sequence
  Synthetic siNA sense region
  misc_feature (1)..(1): 5'-3 attached terminal deoxyabasic moiety
  misc_feature (1)..(2): 2'-O-methyl
  misc_feature (3)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(13): 2'-deoxy-2'-fluoro
  misc_feature (14)..(14): 2'-O-methyl
  misc_feature (15)..(16): 2'-deoxy-2'-fluoro
  misc_feature (17)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gaccacuaugcccacugactt

SEQ ID NO: 1362 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(8): 2'-deoxy-2'-fluoro
  misc_feature (9)..(10): 2'-O-methyl
  misc_feature (11)..(11): 2'-deoxy-2'-fluoro
  misc_feature (12)..(12): 2'-O-methyl
  misc_feature (13)..(17): 2'-deoxy-2'-fluoro
  misc_feature (18)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
acucccucaguguuuccactt

SEQ ID NO: 1363 - DNA, 21 bp, Artificial Sequence
  Synthetic siNA sense region
  misc_feature (1)..(1): 5'-3 attached terminal deoxyabasic moiety
  misc_feature (1)..(2): 2'-O-methyl
  misc_feature (3)..(6): 2'-deoxy-2'-fluoro
  misc_feature (7)..(7): 2'-O-methyl
  misc_feature (8)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
aaccucacucugcauuauutt

SEQ ID NO: 1364 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(2): 2'-deoxy-2'-fluoro
  misc_feature (3)..(6): 2'-O-methyl
  misc_feature (7)..(9): 2'-deoxy-2'-fluoro
  misc_feature (10)..(14): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (21)..(21): 3'-3 attached terminal deoxyabasic moiety
  misc_feature (1)..(19): ribonucleotide/modified as described
auaaaguccagaagugcagtt

SEQ ID NO: 1365 - DNA, 21 bp, Artificial Sequence
  Synthetic siNA sense region
  misc_feature (1)..(1): 2'-deoxy-2'-fluoro
  misc_feature (1)..(1): 5'-3 attached terminal deoxyabasic moiety
  misc_feature (2)..(5): 2'-O-methyl
  misc_feature (6)..(8): 2'-deoxy-2'-fluoro
  misc_feature (9)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uaaaguccagaagugcagctt

SEQ ID NO: 1366 - DNA, 21 bp, Artificial Sequence
  Synthetic siNA sense region
  misc_feature (1)..(1): 5'-3 attached terminal deoxyabasic moiety
  misc_feature (1)..(2): 2'-deoxy-2'-fluoro
  misc_feature (3)..(3): 2'-O-methyl
  misc_feature (4)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
ucacuucuggcugucaguutt

SEQ ID NO: 1367 - DNA, 21 bp, Artificial Sequence
  Synthetic siNA antisense region
  misc_feature (1)..(8): 2'-O-methyl
  misc_feature (9)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
ggaagaaaucagcuguggutt

SEQ ID NO: 1368 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(3): 2'-O-methyl
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(9): 2'-O-methyl
  misc_feature (10)..(11): 2'-deoxy-2'-fluoro
  misc_feature (12)..(19): 2'-O-methyl
  misc_feature (20)..(20): Phosphorothioate 3'-Internucleotide Linkage
  misc_feature (1)..(19): ribonucleotide/modified as described
gcauaguggucaggaagaatt

SEQ ID NO: 1369 - DNA, 21 bp, Artificial Sequence
  Synthetic siNA antisense region
  misc_feature (1)..(1): 2'-O-methyl
  misc_feature (2)..(3): 2'-deoxy-2'-fluoro
  misc_feature (4)..(5): 2'-O-methyl
  misc_feature (6)..(6): 2'-deoxy-2'-fluoro
  misc_feature (7)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-O-methyl
  misc_feature (15)..(15): 2'-deoxy-2'-fluoro
  misc_feature (16)..(17): 2'-O-methyl
  misc_feature (18)..(19): 2'-deoxy-2'-fluoro
  misc_feature (20)..(20): Phosphorothioate 3'-Internucleotide Linkage
  misc_feature (1)..(19): ribonucleotide/modified as described
gucagugggcauagugguctt

SEQ ID NO: 1370 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(7): 2'-O-methyl
  misc_feature (8)..(8): 2'-deoxy-2'-fluoro
  misc_feature (9)..(9): 2'-O-methyl
  misc_feature (10)..(11): 2'-deoxy-2'-fluoro
  misc_feature (12)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
guggaaacacugagggagutt

SEQ ID NO: 1371 - DNA, 21 bp, Artificial Sequence
  Synthetic siNA antisense region
  misc_feature (1)..(2): 2'-O-methyl
  misc_feature (3)..(3): 2'-deoxy-2'-fluoro
  misc_feature (4)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(12): 2'-O-methyl
  misc_feature (13)..(13): 2'-deoxy-2'-fluoro
  misc_feature (14)..(17): 2'-O-methyl
  misc_feature (18)..(19): 2'-deoxy-2'-fluoro
  misc_feature (20)..(20): Phosphorothioate 3'-Internucleotide Linkage
  misc_feature (1)..(19): ribonucleotide/modified as described
aauaaugcagagugagguutt

SEQ ID NO: 1372 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(5): 2'-O-methyl
  misc_feature (6)..(10): 2'-deoxy-2'-fluoro
  misc_feature (11)..(13): 2'-O-methyl
  misc_feature (14)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
cugcacuucuggacuuuautt

SEQ ID NO: 1373 - DNA, 21 bp, Artificial Sequence
  Synthetic siNA antisense region
  misc_feature (1)..(1): 2'-O-methyl
  misc_feature (2)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(11): 2'-deoxy-2'-fluoro
  misc_feature (12)..(14): 2'-O-methyl
  misc_feature (15)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide/modified as described
gcugcacuucuggacuuuatt

SEQ ID NO: 1374 - DNA, 21 bp, Artificial Sequence
  Synthetic siNA antisense region
  misc_feature (1)..(2): 2'-O-methyl
  misc_feature (3)..(4): 2'-deoxy-2'-fluoro
  misc_feature (5)..(6): 2'-O-methyl
  misc_feature (7)..(7): 2'-deoxy-2'-fluoro
  misc_feature (8)..(9): 2'-O-methyl
  misc_feature (10)..(11): 2'-deoxy-2'-fluoro
  misc_feature (12)..(16): 2'-O-methyl
  misc_feature (17)..(17): 2'-deoxy-2'-fluoro
  misc_feature (18)..(19): 2'-O-methyl
  misc_feature (20)..(20): Phosphorothioate 3'-Internucleotide Linkage
  misc_feature (1)..(19): ribonucleotide/modified as described
aacugacagccagaagugatt

SEQ ID NO: 1375 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
accacagcugauuucuucctt

SEQ ID NO: 1376 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
uucuuccugaccacuaugctt

SEQ ID NO: 1377 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
gaccacuaugcccacugactt

SEQ ID NO: 1378 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
acucccucaguguuuccactt

SEQ ID NO: 1379 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
aaccucacucugcauuauutt

SEQ ID NO: 1380 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
auaaaguccagaagugcagtt

SEQ ID NO: 1381 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
uaaaguccagaagugcagctt

SEQ ID NO: 1382 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
ucacuucuggcugucaguutt

SEQ ID NO: 1383 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ggaagaaaucagcuguggutt

SEQ ID NO: 1384 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcauaguggucaggaagaatt

SEQ ID NO: 1385 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gucagugggcauagugguctt

SEQ ID NO: 1386 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
guggaaacacugagggagutt

SEQ ID NO: 1387 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aauaaugcagagugagguutt

SEQ ID NO: 1388 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cugcacuucuggacuuuautt

SEQ ID NO: 1389 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcugcacuucuggacuuuatt

SEQ ID NO: 1390 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aacugacagccagaagugatt

SEQ ID NO: 1391 - DNA, 21 bp, Artificial Sequence
  Synthetic siNA antisense region
  misc_feature (1)..(1): 5'-3 attached terminal deoxyabasic moiety
  misc_feature (9)..(10): 2'-deoxy-2'-fluoro
  misc_feature (13)..(14): 2'-deoxy-2'-fluoro
  misc_feature (16)..(16): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
ggaagaaaucagcuguggutt

SEQ ID NO: 1392 - DNA, 21 bp, Artificial Sequence
  Synthetic siNA antisense region
  misc_feature (1)..(1): 5'-3 attached terminal deoxyabasic moiety
  misc_feature (2)..(2): 2'-deoxy-2'-fluoro
  misc_feature (4)..(4): 2'-deoxy-2'-fluoro
  misc_feature (7)..(7): 2'-deoxy-2'-fluoro
  misc_feature (10)..(11): 2'-deoxy-2'-fluoro
  misc_feature (21)..(21): 3'-3 attached terminal deoxyabasic moiety
  misc_feature (1)..(19): ribonucleotide/modified as described
gcauaguggucaggaagaatt

SEQ ID NO: 1393 - DNA, 21 bp, Artificial Sequence
  Synthetic siNA antisense region
  misc_feature (1)..(1): 5'-3 attached terminal deoxyabasic moiety
  misc_feature (2)..(3): 2'-deoxy-2'-fluoro
  misc_feature (6)..(6): 2'-deoxy-2'-fluoro
  misc_feature (10)..(10): 2'-deoxy-2'-fluoro
  misc_feature (12)..(12): 2'-deoxy-2'-fluoro
  misc_feature (15)..(15): 2'-deoxy-2'-fluoro
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
gucagugggcauagugguctt

SEQ ID NO: 1394 - DNA, 21 bp, Artificial Sequence
  Synthetic siNA antisense region
  misc_feature (1)..(1): 5'-3 attached terminal deoxyabasic moiety
  misc_feature (2)..(2): 2'-deoxy-2'-fluoro
  misc_feature (8)..(8): 2'-deoxy-2'-fluoro
  misc_feature (10)..(11): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
guggaaacacugagggagutt

SEQ ID NO: 1395 - DNA, 21 bp, Artificial Sequence
  Synthetic siNA antisense region
  misc_feature (1)..(1): 5'-3 attached terminal deoxyabasic moiety
  misc_feature (3)..(3): 2'-deoxy-2'-fluoro
  misc_feature (6)..(6): 2'-deoxy-2'-fluoro
  misc_feature (8)..(8): 2'-deoxy-2'-fluoro
  misc_feature (13)..(13): 2'-deoxy-2'-fluoro
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
aauaaugcagagugagguutt

SEQ ID NO: 1396 - DNA, 21 bp, Artificial Sequence
  Synthetic siNA antisense region
  misc_feature (1)..(1): 5'-3 attached terminal deoxyabasic moiety
  misc_feature (1)..(2): 2'-deoxy-2'-fluoro
  misc_feature (4)..(4): 2'-deoxy-2'-fluoro
  misc_feature (6)..(10): 2'-deoxy-2'-fluoro
  misc_feature (14)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
cugcacuucuggacuuuautt

SEQ ID NO: 1397 - DNA, 21 bp, Artificial Sequence
  Synthetic siNA antisense region
  misc_feature (1)..(1): 5'-3 attached terminal deoxyabasic moiety
  misc_feature (2)..(3): 2'-deoxy-2'-fluoro
  misc_feature (5)..(5): 2'-deoxy-2'-fluoro
  misc_feature (7)..(11): 2'-deoxy-2'-fluoro
  misc_feature (15)..(18): 2'-deoxy-2'-fluoro
  misc_feature (21)..(21): 3'-3 attached terminal deoxyabasic moiety
  misc_feature (1)..(19): ribonucleotide/modified as described
gcugcacuucuggacuuuatt

SEQ ID NO: 1398 - DNA, 21 bp, Artificial Sequence
  Synthetic siNA antisense region
  misc_feature (1)..(1): 5'-3 attached terminal deoxyabasic moiety
  misc_feature (3)..(4): 2'-deoxy-2'-fluoro
  misc_feature (7)..(7): 2'-deoxy-2'-fluoro
  misc_feature (10)..(11): 2'-deoxy-2'-fluoro
  misc_feature (17)..(17): 2'-deoxy-2'-fluoro
  misc_feature (21)..(21): 3'-3 attached terminal deoxyabasic moiety
  misc_feature (1)..(19): ribonucleotide/modified as described
aacugacagccagaagugatt

SEQ ID NO: 1399 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
ggaagaaaucagcuguggutt

SEQ ID NO: 1400 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
gcauaguggucaggaagaatt

SEQ ID NO: 1401 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
gucagugggcauagugguctt

SEQ ID NO: 1402 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
guggaaacacugagggagutt

SEQ ID NO: 1403 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
aauaaugcagagugagguutt

SEQ ID NO: 1404 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
cugcacuucuggacuuuautt

SEQ ID NO: 1405 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
gcugcacuucuggacuuuatt

SEQ ID NO: 1406 - DNA, 21 bp, Artificial Sequence
  Synthetic siNA antisense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
aacugacagccagaagugatt

SEQ ID NO: 1407 - DNA, 21 bp, Artificial Sequence
  Synthetic siNA sense region
  misc_feature (1)..(19): ribonucleotide/modified as described
gccucacagagcagaagactt

SEQ ID NO: 1408 - DNA, 21 bp, Artificial Sequence
  Synthetic siNA sense region
  misc_feature (1)..(19): ribonucleotide/modified as described
cucacagagcagaagacuctt

SEQ ID NO: 1409 - DNA, 21 bp, Artificial Sequence
  Synthetic siNA sense region
  misc_feature (1)..(19): ribonucleotide/modified as described
gaguugaccguaacagacatt

SEQ ID NO: 1410 - DNA, 21 bp, Artificial Sequence
  Synthetic siNA sense region
  misc_feature (1)..(19): ribonucleotide/modified as described
uaacagacaucuuugcugctt

SEQ ID NO: 1411 - DNA, 21 bp, Artificial Sequence
  Synthetic siNA sense region
  misc_feature (1)..(19): ribonucleotide/modified as described
cuccaagaacacaacugagtt

SEQ ID NO: 1412 - DNA, 21 bp, Artificial Sequence
  Synthetic siNA sense region
  misc_feature (1)..(19): ribonucleotide/modified as described
uacagccaccaugagaaggtt

SEQ ID NO: 1413 - DNA, 21 bp, Artificial Sequence
  Synthetic siNA sense region
  misc_feature (1)..(19): ribonucleotide/modified as described
gaauuccuguccugugaagtt

SEQ ID NO: 1414 - DNA, 21 bp, Artificial Sequence
  Synthetic siNA sense region
  misc_feature (1)..(19): ribonucleotide/modified as described
aggaagccaaccagaguactt

SEQ ID NO: 1415 - DNA, 21 bp, Artificial Sequence
  Synthetic siNA antisense region
  misc_feature (1)..(19): ribonucleotide/modified as described
gucuucugcucugugaggctt

SEQ ID NO: 1416 - DNA, 21 bp, Artificial Sequence
  Synthetic siNA antisense region
  misc_feature (1)..(19): ribonucleotide/modified as described
gagucuucugcucugugagtt

SEQ ID NO: 1417 - DNA, 21 bp, Artificial Sequence
  Synthetic siNA antisense region
  misc_feature (1)..(19): ribonucleotide/modified as described
ugucuguuacggucaacuctt

SEQ ID NO: 1418 - DNA, 21 bp, Artificial Sequence
  Synthetic siNA antisense region
  misc_feature (1)..(19): ribonucleotide/modified as described
gcagcaaagaugucuguuatt

SEQ ID NO: 1419 - DNA, 21 bp, Artificial Sequence
  Synthetic siNA antisense region
  misc_feature (1)..(19): ribonucleotide/modified as described
cucaguuguguucuuggagtt

SEQ ID NO: 1420 - DNA, 21 bp, Artificial Sequence
  Synthetic siNA antisense region
  misc_feature (1)..(19): ribonucleotide/modified as described
ccuucucaugguggcuguatt

SEQ ID NO: 1421 - DNA, 21 bp, Artificial Sequence
  Synthetic siNA antisense region
  misc_feature (1)..(19): ribonucleotide/modified as described
cuucacaggacaggaauuctt

SEQ ID NO: 1422 - DNA, 21 bp, Artificial Sequence
  Synthetic siNA antisense region
  misc_feature (1)..(19): ribonucleotide/modified as described
guacucugguuggcuuccutt

SEQ ID NO: 1423 - DNA, 21 bp, Artificial Sequence
  Synthetic siNA sense region
  misc_feature (1)..(1): 5'-3 attached terminal deoxyabasic moiety
  misc_feature (2)..(5): 2'-deoxy-2'-fluoro
  misc_feature (7)..(7): 2'-deoxy-2'-fluoro
  misc_feature (12)..(12): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gccucacagagcagaagactt

SEQ ID NO: 1424 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (5)..(5): 2'-deoxy-2'-fluoro
  misc_feature (10)..(10): 2'-deoxy-2'-fluoro
  misc_feature (17)..(19): 2'-deoxy-2'-fluoro
  misc_feature (21)..(21): 3'-3 attached terminal deoxyabasic moiety
  misc_feature (1)..(19): ribonucleotide/modified as described
cucacagagcagaagacuctt

SEQ ID NO: 1425 - DNA, 21 bp, Artificial Sequence
  Synthetic siNA sense region
  misc_feature (1)..(1): 5'-3 attached terminal deoxyabasic moiety
  misc_feature (4)..(5): 2'-deoxy-2'-fluoro
  misc_feature (8)..(9): 2'-deoxy-2'-fluoro
  misc_feature (11)..(11): 2'-deoxy-2'-fluoro
  misc_feature (14)..(14): 2'-deoxy-2'-fluoro
  misc_feature (18)..(18): 2'-deoxy-2'-fluoro
  misc_feature (21)..(21): 3'-3 attached terminal deoxyabasic moiety
  misc_feature (1)..(19): ribonucleotide/modified as described
gaguugaccguaacagacatt

SEQ ID NO: 1426 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (4)..(4): 2'-deoxy-2'-fluoro
  misc_feature (8)..(8): 2'-deoxy-2'-fluoro
  misc_feature (10)..(14): 2'-deoxy-2'-fluoro
  misc_feature (16)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uaacagacaucuuugcugctt

SEQ ID NO: 1427 - DNA, 21 bp, Artificial Sequence
  Synthetic siNA sense region
  misc_feature (1)..(1): 5'-3 attached terminal deoxyabasic moiety
  misc_feature (1)..(4): 2'-deoxy-2'-fluoro
  misc_feature (10)..(10): 2'-deoxy-2'-fluoro
  misc_feature (12)..(12): 2'-deoxy-2'-fluoro
  misc_feature (15)..(16): 2'-deoxy-2'-fluoro
  misc_feature (21)..(21): 3'-3 attached terminal deoxyabasic moiety
  misc_feature (1)..(19): ribonucleotide/modified as described
cuccaagaacacaacugagtt

SEQ ID NO: 1428 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(3): 2'-deoxy-2'-fluoro
  misc_feature (6)..(7): 2'-deoxy-2'-fluoro
  misc_feature (9)..(10): 2'-deoxy-2'-fluoro
  misc_feature (12)..(12): 2'-deoxy-2'-fluoro
  misc_feature (21)..(21): 3'-3 attached terminal deoxyabasic moiety
  misc_feature (1)..(19): ribonucleotide/modified as described
uacagccaccaugagaaggtt

SEQ ID NO: 1429 - DNA, 21 bp, Artificial Sequence
  Synthetic siNA sense region
  misc_feature (1)..(1): 5'-3 attached terminal deoxyabasic moiety
  misc_feature (4)..(8): 2'-deoxy-2'-fluoro
  misc_feature (10)..(13): 2'-deoxy-2'-fluoro
  misc_feature (16)..(16): 2'-deoxy-2'-fluoro
  misc_feature (21)..(21): 3'-3 attached terminal deoxyabasic moiety
  misc_feature (1)..(19): ribonucleotide/modified as described
gaauuccuguccugugaagtt

SEQ ID NO: 1430 - DNA, 21 bp, Artificial Sequence
  Synthetic siNA sense region
  misc_feature (1)..(1): 5'-3 attached terminal deoxyabasic moiety
  misc_feature (7)..(8): 2'-deoxy-2'-fluoro
  misc_feature (11)..(12): 2'-deoxy-2'-fluoro
  misc_feature (17)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
aggaagccaaccagaguactt

SEQ ID NO: 1431 - DNA, 21 bp, Artificial Sequence
  Synthetic siNA antisense region
  misc_feature (2)..(7): 2'-deoxy-2'-fluoro
  misc_feature (9)..(12): 2'-deoxy-2'-fluoro
  misc_feature (14)..(14): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
gucuucugcucugugaggctt

SEQ ID NO: 1432 - DNA, 21 bp, Artificial Sequence
  Synthetic siNA antisense region
  misc_feature (4)..(9): 2'-deoxy-2'-fluoro
  misc_feature (11)..(14): 2'-deoxy-2'-fluoro
  misc_feature (16)..(16): 2'-deoxy-2'-fluoro
  misc_feature (20)..(20): Phosphorothioate 3'-Internucleotide Linkage
  misc_feature (1)..(19): ribonucleotide/modified as described
gagucuucugcucugugagtt

SEQ ID NO: 1433 - DNA, 21 bp, Artificial Sequence
  Synthetic siNA antisense region
  misc_feature (1)..(1): 2'-deoxy-2'-fluoro
  misc_feature (3)..(5): 2'-deoxy-2'-fluoro
  misc_feature (7)..(8): 2'-deoxy-2'-fluoro
  misc_feature (10)..(10): 2'-deoxy-2'-fluoro
  misc_feature (13)..(14): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide/modified as described
ugucuguuacggucaacuctt

SEQ ID NO: 1434 - DNA, 21 bp, Artificial Sequence
  Synthetic siNA antisense region
  misc_feature (2)..(2): 2'-deoxy-2'-fluoro
  misc_feature (5)..(5): 2'-deoxy-2'-fluoro
  misc_feature (11)..(11): 2'-deoxy-2'-fluoro
  misc_feature (13)..(15): 2'-deoxy-2'-fluoro
  misc_feature (17)..(18): 2'-deoxy-2'-fluoro
  misc_feature (20)..(20): Phosphorothioate 3'-Internucleotide Linkage
  misc_feature (1)..(19): ribonucleotide/modified as described
gcagcaaagaugucuguuatt

SEQ ID NO: 1435 - DNA, 21 bp, Artificial Sequence
  Synthetic siNA antisense region
  misc_feature (1)..(3): 2'-deoxy-2'-fluoro
  misc_feature (6)..(7): 2'-deoxy-2'-fluoro
  misc_feature (9)..(9): 2'-deoxy-2'-fluoro
  misc_feature (11)..(15): 2'-deoxy-2'-fluoro
  misc_feature (20)..(20): Phosphorothioate 3'-Internucleotide Linkage
  misc_feature (1)..(19): ribonucleotide/modified as described
cucaguuguguucuuggagtt

SEQ ID NO: 1436 - DNA, 21 bp, Artificial Sequence
  Synthetic siNA antisense region
  misc_feature (1)..(7): 2'-deoxy-2'-fluoro
  misc_feature (9)..(9): 2'-deoxy-2'-fluoro
  misc_feature (12)..(12): 2'-deoxy-2'-fluoro
  misc_feature (15)..(16): 2'-deoxy-2'-fluoro
  misc_feature (18)..(18): 2'-deoxy-2'-fluoro
  misc_feature (20)..(20): Phosphorothioate 3'-Internucleotide Linkage
  misc_feature (1)..(19): ribonucleotide/modified as described
ccuucucaugguggcuguatt

SEQ ID NO: 1437 - DNA, 21 bp, Artificial Sequence
  Synthetic siNA antisense region
  misc_feature (1)..(4): 2'-deoxy-2'-fluoro
  misc_feature (6)..(6): 2'-deoxy-2'-fluoro
  misc_feature (11)..(11): 2'-deoxy-2'-fluoro
  misc_feature (17)..(19): 2'-deoxy-2'-fluoro
  misc_feature (20)..(20): Phosphorothioate 3'-Internucleotide Linkage
  misc_feature (1)..(19): ribonucleotide/modified as described
cuucacaggacaggaauuctt

SEQ ID NO: 1438 - DNA, 21 bp, Artificial Sequence
  Synthetic siNA antisense region
  misc_feature (2)..(2): 2'-deoxy-2'-fluoro
  misc_feature (4)..(7): 2'-deoxy-2'-fluoro
  misc_feature (10)..(11): 2'-deoxy-2'-fluoro
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
guacucugguuggcuuccutt

SEQ ID NO: 1439 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(5): 2'-deoxy-2'-fluoro
  misc_feature (6)..(6): 2'-deoxy
  misc_feature (7)..(7): 2'-deoxy-2'-fluoro
  misc_feature (8)..(11): 2'-deoxy
  misc_feature (12)..(12): 2'-deoxy-2'-fluoro
  misc_feature (13)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gccucacagagcagaagactt

SEQ ID NO: 1440 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(10): 2'-deoxy-2'-fluoro
  misc_feature (11)..(16): 2'-deoxy
  misc_feature (17)..(19): 2'-deoxy-2'-fluoro
  misc_feature (21)..(21): 3'-3 attached terminal deoxyabasic moiety
  misc_feature (1)..(19): ribonucleotide/modified as described
cucacagagcagaagacuctt

SEQ ID NO: 1441 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy
  misc_feature (4)..(5): 2'-deoxy-2'-fluoro
  misc_feature (6)..(7): 2'-deoxy
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): 3'-3 attached terminal deoxyabasic moiety
  misc_feature (1)..(19): ribonucleotide/modified as described
gaguugaccguaacagacatt

SEQ ID NO: 1442 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (5)..(7): 2'-deoxy
  misc_feature (8)..(8): 2'-deoxy-2'-fluoro
  misc_feature (9)..(9): 2'-deoxy
  misc_feature (10)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uaacagacaucuuugcugctt

SEQ ID NO: 1443 - DNA, 21 bp, Artificial Sequence
  Synthetic siNA sense region
  misc_feature (1)..(1): 5'-3 attached terminal deoxyabasic moiety
  misc_feature (1)..(4): 2'-deoxy-2'-fluoro
  misc_feature (5)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(16): 2'-deoxy-2'-fluoro
  misc_feature (17)..(19): 2'-deoxy
  misc_feature (21)..(21): 3'-3 attached terminal deoxyabasic moiety
  misc_feature (1)..(19): ribonucleotide/modified as described
cuccaagaacacaacugagtt

SEQ ID NO: 1444 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(19): 2'-deoxy
  misc_feature (21)..(21): 3'-3 attached terminal deoxyabasic moiety
  misc_feature (1)..(19): ribonucleotide/modified as described
uacagccaccaugagaaggtt

SEQ ID NO: 1445 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy
  misc_feature (4)..(8): 2'-deoxy-2'-fluoro
  misc_feature (9)..(9): 2'-deoxy
  misc_feature (10)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (21)..(21): 3'-3 attached terminal deoxyabasic moiety
  misc_feature (1)..(19): ribonucleotide/modified as described
gaauuccuguccugugaagtt

SEQ ID NO: 1446 - DNA, 21 bp, Artificial Sequence
  Synthetic siNA sense region
  misc_feature (1)..(1): 5'-3 attached terminal deoxyabasic moiety
  misc_feature (1)..(6): 2'-deoxy
  misc_feature (7)..(8): 2'-deoxy-2'-fluoro
  misc_feature (9)..(10): 2'-deoxy
  misc_feature (11)..(12): 2'-deoxy-2'-fluoro
  misc_feature (13)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
aggaagccaaccagaguactt

SEQ ID NO: 1447 - DNA, 21 bp, Artificial Sequence
  Synthetic siNA antisense region
  misc_feature (1)..(1): 2'-deoxy
  misc_feature (2)..(7): 2'-deoxy-2'-fluoro
  misc_feature (8)..(8): 2'-deoxy
  misc_feature (9)..(12): 2'-deoxy-2'-fluoro
  misc_feature (13)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
gucuucugcucugugaggctt

SEQ ID NO: 1448 - DNA, 21 bp, Artificial Sequence
  Synthetic siNA antisense region
  misc_feature (1)..(3): 2'-deoxy
  misc_feature (4)..(9): 2'-deoxy-2'-fluoro
  misc_feature (10)..(10): 2'-deoxy
  misc_feature (11)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (20)..(20): Phosphorothioate 3'-Internucleotide Linkage
  misc_feature (1)..(19): ribonucleotide/modified as described
gagucuucugcucugugagtt

SEQ ID NO: 1449 - DNA, 21 bp, Artificial Sequence
  Synthetic siNA antisense region
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(12): 2'-deoxy
  misc_feature (13)..(14): 2'-deoxy-2'-fluoro
  misc_feature (15)..(16): 2'-deoxy
  misc_feature (17)..(19): 2'-deoxy-2'-fluoro
  misc_feature (20)..(20): Phosphorothioate 3'-Internucleotide Linkage
  misc_feature (1)..(19): ribonucleotide/modified as described
ugucuguuacggucaacuctt

SEQ ID NO: 1450 - DNA, 21 bp, Artificial Sequence
  Synthetic siNA antisense region
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(10): 2'-deoxy
  misc_feature (11)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (20)..(20): Phosphorothioate 3'-Internucleotide Linkage
  misc_feature (1)..(19): ribonucleotide/modified as described
gcagcaaagaugucuguuatt

SEQ ID NO: 1451 - DNA, 21 bp, Artificial Sequence
  Synthetic siNA antisense region
  misc_feature (1)..(3): 2'-deoxy-2'-fluoro
  misc_feature (4)..(5): 2'-deoxy
  misc_feature (6)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(15): 2'-deoxy-2'-fluoro
  misc_feature (16)..(19): 2'-deoxy
  misc_feature (20)..(20): Phosphorothioate 3'-Internucleotide Linkage
  misc_feature (1)..(19): ribonucleotide/modified as described
cucaguuguguucuuggagtt

SEQ ID NO: 1452 - DNA, 21 bp, Artificial Sequence
  Synthetic siNA antisense region
  misc_feature (1)..(7): 2'-deoxy-2'-fluoro
  misc_feature (8)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (20)..(20): Phosphorothioate 3'-Internucleotide Linkage
  misc_feature (1)..(19): ribonucleotide/modified as described
ccuucucaugguggcuguatt

SEQ ID NO: 1453 - DNA, 21 bp, Artificial Sequence
  Synthetic siNA antisense region
  misc_feature (1)..(4): 2'-deoxy-2'-fluoro
  misc_feature (5)..(5): 2'-deoxy
  misc_feature (6)..(6): 2'-deoxy-2'-fluoro
  misc_feature (7)..(10): 2'-deoxy
  misc_feature (11)..(11): 2'-deoxy-2'-fluoro
  misc_feature (12)..(16): 2'-deoxy
  misc_feature (17)..(19): 2'-deoxy-2'-fluoro
  misc_feature (20)..(20): Phosphorothioate 3'-Internucleotide Linkage
  misc_feature (1)..(19): ribonucleotide/modified as described
cuucacaggacaggaauuctt

SEQ ID NO: 1454 - DNA, 21 bp, Artificial Sequence
  Synthetic siNA antisense region
  misc_feature (1)..(1): 2'-deoxy
  misc_feature (2)..(2): 2'-deoxy-2'-fluoro
  misc_feature (3)..(3): 2'-deoxy
  misc_feature (4)..(7): 2'-deoxy-2'-fluoro
  misc_feature (8)..(9): 2'-deoxy
  misc_feature (10)..(11): 2'-deoxy-2'-fluoro
  misc_feature (12)..(13): 2'-deoxy
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
guacucugguuggcuuccutt

SEQ ID NO: 1455 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(5): 2'-deoxy-2'-fluoro
  misc_feature (6)..(6): 2'-O-methyl
  misc_feature (7)..(7): 2'-deoxy-2'-fluoro
  misc_feature (8)..(11): 2'-O-methyl
  misc_feature (12)..(12): 2'-deoxy-2'-fluoro
  misc_feature (13)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gccucacagagcagaagactt

SEQ ID NO: 1456 - DNA, 21 bp, Artificial Sequence
  Synthetic siNA sense region
  misc_feature (1)..(1): 5'-3 attached terminal deoxyabasic moiety
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (6)..(9): 2'-O-methyl
  misc_feature (10)..(10): 2'-deoxy-2'-fluoro
  misc_feature (11)..(16): 2'-O-methyl
  misc_feature (17)..(19): 2'-deoxy-2'-fluoro
  misc_feature (21)..(21): 3'-3 attached terminal deoxyabasic moiety
  misc_feature (1)..(19): ribonucleotide/modified as described
cucacagagcagaagacuctt

SEQ ID NO: 1457 - DNA, 21 bp, Artificial Sequence
  Synthetic siNA sense region
  misc_feature (1)..(1): 5'-3 attached terminal deoxyabasic moiety
  misc_feature (1)..(3): 2'-O-methyl
  misc_feature (4)..(5): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(19): 2'-O-methyl
  misc_feature (21)..(21): 3'-3 attached terminal deoxyabasic moiety
  misc_feature (1)..(19): ribonucleotide/modified as described
gaguugaccguaacagacatt

SEQ ID NO: 1458 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(9): 2'-O-methyl
  misc_feature (10)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
uaacagacaucuuugcugctt

SEQ ID NO: 1459 - DNA, 21 bp, Artificial Sequence
  Synthetic siNA sense region
  misc_feature (1)..(1): 5'-3 attached terminal deoxyabasic moiety
  misc_feature (1)..(4): 2'-deoxy-2'-fluoro
  misc_feature (5)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-O-methyl
  misc_feature (15)..(16): 2'-deoxy-2'-fluoro
  misc_feature (17)..(19): 2'-O-methyl
  misc_feature (21)..(21): 3'-3 attached terminal deoxyabasic moiety
  misc_feature (1)..(19): ribonucleotide/modified as described
cuccaagaacacaacugagtt

SEQ ID NO: 1460 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(5): 2'-O-methyl
  misc_feature (6)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(12): 2'-deoxy-2'-fluoro
  misc_feature (13)..(19): 2'-O-methyl
  misc_feature (21)..(21): 3'-3 attached terminal deoxyabasic moiety
  misc_feature (1)..(19): ribonucleotide/modified as described
uacagccaccaugagaaggtt

SEQ ID NO: 1461 - DNA, 21 bp, Artificial Sequence
  Synthetic siNA sense region
  misc_feature (1)..(1): 5'-3 attached terminal deoxyabasic moiety
  misc_feature (1)..(3): 2'-O-methyl
  misc_feature (4)..(8): 2'-deoxy-2'-fluoro
  misc_feature (9)..(9): 2'-O-methyl
  misc_feature (10)..(13): 2'-deoxy-2'-fluoro
  misc_feature (14)..(14): 2'-O-methyl
  misc_feature (15)..(15): 2'-deoxy-2'-fluoro
  misc_feature (16)..(19): 2'-O-methyl
  misc_feature (21)..(21): 3'-3 attached terminal deoxyabasic moiety
  misc_feature (1)..(19): ribonucleotide/modified as described
gaauuccuguccugugaagtt

SEQ ID NO: 1462 - DNA, 21 bp, Artificial Sequence
  Synthetic siNA sense region
  misc_feature (1)..(1): 5'-3 attached terminal deoxyabasic moiety
  misc_feature (1)..(6): 2'-O-methyl
  misc_feature (7)..(8): 2'-deoxy-2'-fluoro
  misc_feature (9)..(10): 2'-O-methyl
  misc_feature (11)..(12): 2'-deoxy-2'-fluoro
  misc_feature (13)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
aggaagccaaccagaguactt

SEQ ID NO: 1463 - DNA, 21 bp, Artificial Sequence
  Synthetic siNA antisense region
  misc_feature (1)..(1): 2'-O-methyl
  misc_feature (2)..(7): 2'-deoxy-2'-fluoro
  misc_feature (8)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(19): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
gucuucugcucugugaggctt

SEQ ID NO: 1464 - DNA, 21 bp, Artificial Sequence
  Synthetic siNA antisense region
  misc_feature (1)..(3): 2'-O-methyl
  misc_feature (4)..(9): 2'-deoxy-2'-fluoro
  misc_feature (10)..(10): 2'-O-methyl
  misc_feature (11)..(14): 2'-deoxy-2'-fluoro
  misc_feature (15)..(19): 2'-O-methyl
  misc_feature (16)..(16): 2'-deoxy-2'-fluoro
  misc_feature (20)..(20): Phosphorothioate 3'-Internucleotide Linkage
  misc_feature (1)..(19): ribonucleotide/modified as described
gagucuucugcucugugagtt

SEQ ID NO: 1465 - DNA, 21 bp, Artificial Sequence
  Synthetic siNA antisense region
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (6)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(14): 2'-deoxy-2'-fluoro
  misc_feature (15)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide/modified as described
ugucuguuacggucaacuctt

SEQ ID NO: 1466 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (6)..(10): 2'-O-methyl
  misc_feature (11)..(11): 2'-deoxy-2'-fluoro
  misc_feature (12)..(12): 2'-O-methyl
  misc_feature (13)..(15): 2'-deoxy-2'-fluoro
  misc_feature (16)..(16): 2'-O-methyl
  misc_feature (17)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide/modified as described
gcagcaaagaugucuguuatt

SEQ ID NO: 1467 - DNA, 21 bp, Artificial Sequence
  Synthetic siNA antisense region
  misc_feature (1)..(3): 2'-deoxy-2'-fluoro
  misc_feature (4)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(15): 2'-deoxy-2'-fluoro
  misc_feature (16)..(19): 2'-O-methyl
  misc_feature (20)..(20): Phosphorothioate 3'-Internucleotide Linkage
  misc_feature (1)..(19): ribonucleotide/modified as described
cucaguuguguucuuggagtt

SEQ ID NO: 1468 - DNA, 21 bp, Artificial Sequence
  Synthetic siNA antisense region
  misc_feature (1)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(14): 2'-O-methyl
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide/modified as described
ccuucucaugguggcuguatt

SEQ ID NO: 1469 - DNA, 21 bp, Artificial Sequence
  Synthetic siNA antisense region
  misc_feature (1)..(4): 2'-deoxy-2'-fluoro
  misc_feature (5)..(5): 2'-O-methyl
  misc_feature (6)..(6): 2'-deoxy-2'-fluoro
  misc_feature (7)..(10): 2'-O-methyl
  misc_feature (11)..(11): 2'-deoxy-2'-fluoro
  misc_feature (12)..(16): 2'-O-methyl
  misc_feature (17)..(19): 2'-deoxy-2'-fluoro
  misc_feature (20)..(20): Phosphorothioate 3'-Internucleotide Linkage
  misc_feature (1)..(19): ribonucleotide/modified as described
cuucacaggacaggaauuctt

SEQ ID NO: 1470 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(3): 2'-O-methyl
  misc_feature (4)..(7): 2'-deoxy-2'-fluoro
  misc_feature (8)..(9): 2'-O-methyl
  misc_feature (10)..(11): 2'-deoxy-2'-fluoro
  misc_feature (12)..(13): 2'-O-methyl
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
guacucugguuggcuuccutt

SEQ ID NO: 1471 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
gccucacagagcagaagactt

SEQ ID NO: 1472 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
cucacagagcagaagacuctt

SEQ ID NO: 1473 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
gaguugaccguaacagacatt

SEQ ID NO: 1474 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
uaacagacaucuuugcugctt

SEQ ID NO: 1475 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
cuccaagaacacaacugagtt

SEQ ID NO: 1476 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
uacagccaccaugagaaggtt

SEQ ID NO: 1477 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
gaauuccuguccugugaagtt

SEQ ID NO: 1478 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
aggaagccaaccagaguactt

SEQ ID NO: 1479 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gucuucugcucugugaggctt

SEQ ID NO: 1480 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gagucuucugcucugugagtt

SEQ ID NO: 1481 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ugucuguuacggucaacuctt

SEQ ID NO: 1482 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcagcaaagaugucuguuatt

SEQ ID NO: 1483 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cucaguuguguucuuggagtt

SEQ ID NO: 1484 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ccuucucaugguggcuguatt

SEQ ID NO: 1485 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cuucacaggacaggaauuctt

SEQ ID NO: 1486 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
guacucugguuggcuuccutt

SEQ ID NO: 1487 - DNA, 21 bp, Artificial Sequence
  Synthetic siNA antisense region
  misc_feature (2)..(7): 2'-deoxy-2'-fluoro
  misc_feature (9)..(12): 2'-deoxy-2'-fluoro
  misc_feature (14)..(14): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
gucuucugcucugugaggctt

SEQ ID NO: 1488 - DNA, 21 bp, Artificial Sequence
  Synthetic siNA antisense region
  misc_feature (4)..(9): 2'-deoxy-2'-fluoro
  misc_feature (11)..(14): 2'-deoxy-2'-fluoro
  misc_feature (16)..(16): 2'-deoxy-2'-fluoro
  misc_feature (21)..(21): 3'-3 attached terminal deoxyabasic moiety
  misc_feature (1)..(19): ribonucleotide/modified as described
gagucuucugcucugugagtt

SEQ ID NO: 1489 - DNA, 21 bp, Artificial Sequence
  Synthetic siNA antisense region
  misc_feature (1)..(1): 2'-deoxy-2'-fluoro
  misc_feature (3)..(5): 2'-deoxy-2'-fluoro
  misc_feature (7)..(8): 2'-deoxy-2'-fluoro
  misc_feature (10)..(10): 2'-deoxy-2'-fluoro
  misc_feature (13)..(14): 2'-deoxy-2'-fluoro
  misc_feature (17)..(19): 2'-deoxy-2'-fluoro
  misc_feature (21)..(21): 3'-3 attached terminal deoxyabasic moiety
  misc_feature (1)..(19): ribonucleotide/modified as described
ugucuguuacggucaacuctt

SEQ ID NO: 1490 - DNA, 21 bp, Artificial Sequence
  Synthetic siNA antisense region
  misc_feature (2)..(2): 2'-deoxy-2'-fluoro
  misc_feature (5)..(5): 2'-deoxy-2'-fluoro
  misc_feature (11)..(11): 2'-deoxy-2'-fluoro
  misc_feature (13)..(15): 2'-deoxy-2'-fluoro
  misc_feature (17)..(18): 2'-deoxy-2'-fluoro
  misc_feature (21)..(21): 3'-3 attached terminal deoxyabasic moiety
  misc_feature (1)..(19): ribonucleotide/modified as described
gcagcaaagaugucuguuatt

SEQ ID NO: 1491 - DNA, 21 bp, Artificial Sequence
  Synthetic siNA antisense region
  misc_feature (1)..(3): 2'-deoxy-2'-fluoro
  misc_feature (6)..(7): 2'-deoxy-2'-fluoro
  misc_feature (9)..(9): 2'-deoxy-2'-fluoro
  misc_feature (11)..(15): 2'-deoxy-2'-fluoro
  misc_feature (21)..(21): 3'-3 attached terminal deoxyabasic moiety
  misc_feature (1)..(19): ribonucleotide/modified as described
cucaguuguguucuuggagtt

SEQ ID NO: 1492 - DNA, 21 bp, Artificial Sequence
  Synthetic siNA antisense region
  misc_feature (1)..(7): 2'-deoxy-2'-fluoro
  misc_feature (9)..(9): 2'-deoxy-2'-fluoro
  misc_feature (12)..(12): 2'-deoxy-2'-fluoro
  misc_feature (15)..(16): 2'-deoxy-2'-fluoro
  misc_feature (18)..(18): 2'-deoxy-2'-fluoro
  misc_feature (21)..(21): 3'-3 attached terminal deoxyabasic moiety
  misc_feature (1)..(19): ribonucleotide/modified as described
ccuucucaugguggcuguatt

SEQ ID NO: 1493 - DNA, 21 bp, Artificial Sequence
  Synthetic siNA antisense region
  misc_feature (1)..(4): 2'-deoxy-2'-fluoro
  misc_feature (6)..(6): 2'-deoxy-2'-fluoro
  misc_feature (11)..(11): 2'-deoxy-2'-fluoro
  misc_feature (17)..(19): 2'-deoxy-2'-fluoro
  misc_feature (21)..(21): 3'-3 attached terminal deoxyabasic moiety
  misc_feature (1)..(19): ribonucleotide/modified as described
cuucacaggacaggaauuctt

SEQ ID NO: 1494 - DNA, 21 bp, Artificial Sequence
  Synthetic siNA antisense region
  misc_feature (2)..(2): 2'-deoxy-2'-fluoro
  misc_feature (4)..(7): 2'-deoxy-2'-fluoro
  misc_feature (10)..(11): 2'-deoxy-2'-fluoro
  misc_feature (14)..(19): 2'-deoxy-2'-fluoro
  misc_feature (21)..(21): 3'-3 attached terminal deoxyabasic moiety
  misc_feature (1)..(19): ribonucleotide/modified as described
guacucugguuggcuuccutt

SEQ ID NO: 1495 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
gucuucugcucugugaggctt

SEQ ID NO: 1496 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
gagucuucugcucugugagtt

SEQ ID NO: 1497 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
ugucuguuacggucaacuctt

SEQ ID NO: 1498 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
gcagcaaagaugucuguuatt

SEQ ID NO: 1499 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
cucaguuguguucuuggagtt

SEQ ID NO: 1500 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
ccuucucaugguggcuguatt

SEQ ID NO: 1501 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
cuucacaggacaggaauuctt

SEQ ID NO: 1502 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
guacucugguuggcuuccutt

SEQ ID NO: 1503 - DNA, 21 bp, Artificial Sequence
  Synthetic siNA sense region
  misc_feature (1)..(19): ribonucleotide/modified as described
auacacuggaccugugggctt

SEQ ID NO: 1504 - DNA, 21 bp, Artificial Sequence
  Synthetic siNA sense region
  misc_feature (1)..(19): ribonucleotide/modified as described
aggaaaccugacaguucactt

SEQ ID NO: 1505 - DNA, 21 bp, Artificial Sequence
  Synthetic siNA sense region
  misc_feature (1)..(19): ribonucleotide/modified as described
cacaacaugaaaagggaugtt

SEQ ID NO: 1506 - DNA, 21 bp, Artificial Sequence
  Synthetic siNA sense region
  misc_feature (1)..(19): ribonucleotide/modified as described
acaacaugaaaagggaugatt

SEQ ID NO: 1507 - DNA, 21 bp, Artificial Sequence
  Synthetic siNA sense region
  misc_feature (1)..(19): ribonucleotide/modified as described
gggaugaagauccucacaatt

SEQ ID NO: 1508 - DNA, 21 bp, Artificial Sequence
  Synthetic siNA sense region
  misc_feature (1)..(19): ribonucleotide/modified as described
gggaaaucgaugagaaauutt

SEQ ID NO: 1509 - DNA, 21 bp, Artificial Sequence
  Synthetic siNA sense region
  misc_feature (1)..(19): ribonucleotide/modified as described
ggaaaucgaugagaaauugtt

SEQ ID NO: 1510 - DNA, 21 bp, Artificial Sequence
  Synthetic siNA sense region
  misc_feature (1)..(19): ribonucleotide/modified as described
auugccuagaggugcucautt

SEQ ID NO: 1511 - DNA, 21 bp, Artificial Sequence
  Synthetic siNA antisense region
  misc_feature (1)..(19): ribonucleotide/modified as described
gcccacagguccaguguautt

SEQ ID NO: 1512 - DNA, 21 bp, Artificial Sequence
  Synthetic siNA antisense region
  misc_feature (1)..(19): ribonucleotide/modified as described
gugaacugucagguuuccutt

SEQ ID NO: 1513 - DNA, 21 bp, Artificial Sequence
  Synthetic siNA antisense region
  misc_feature (1)..(19): ribonucleotide/modified as described
caucccuuuucauguugugtt

SEQ ID NO: 1514 - DNA, 21 bp, Artificial Sequence
  Synthetic siNA antisense region
  misc_feature (1)..(19): ribonucleotide/modified as described
ucaucccuuuucauguugutt

SEQ ID NO: 1515 - DNA, 21 bp, Artificial Sequence
  Synthetic siNA antisense region
  misc_feature (1)..(19): ribonucleotide/modified as described
uugugaggaucuucauccctt

SEQ ID NO: 1516 - DNA, 21 bp, Artificial Sequence
  Synthetic siNA antisense region
  misc_feature (1)..(19): ribonucleotide/modified as described
aauuucucaucgauuuccctt

SEQ ID NO: 1517 - DNA, 21 bp, Artificial Sequence
  Synthetic siNA antisense region
  misc_feature (1)..(19): ribonucleotide/modified as described
caauuucucaucgauuucctt

SEQ ID NO: 1518 - DNA, 21 bp, Artificial Sequence
  Synthetic siNA antisense region
  misc_feature (1)..(19): ribonucleotide/modified as described
augagcaccucuaggcaautt

SEQ ID NO: 1519 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (4)..(4): 2'-deoxy-2'-fluoro
  misc_feature (6)..(7): 2'-deoxy-2'-fluoro
  misc_feature (11)..(13): 2'-deoxy-2'-fluoro
  misc_feature (15)..(15): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
auacacuggaccugugggctt

SEQ ID NO: 1520 - DNA, 21 bp, Artificial Sequence
  Synthetic siNA sense region
  misc_feature (1)..(1): 5'-3 attached terminal deoxyabasic moiety
  misc_feature (7)..(9): 2'-deoxy-2'-fluoro
  misc_feature (12)..(12): 2'-deoxy-2'-fluoro
  misc_feature (15)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
aggaaaccugacaguucactt

SEQ ID NO: 1521 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (3)..(3): 2'-deoxy-2'-fluoro
  misc_feature (6)..(6): 2'-deoxy-2'-fluoro
  misc_feature (8)..(8): 2'-deoxy-2'-fluoro
  misc_feature (18)..(18): 2'-deoxy-2'-fluoro
  misc_feature (21)..(21): 3'-3 attached terminal deoxyabasic moiety
  misc_feature (1)..(19): ribonucleotide/modified as described
cacaacaugaaaagggaugtt

SEQ ID NO: 1522 - DNA, 21 bp, Artificial Sequence
  Synthetic siNA sense region
  misc_feature (1)..(1): 5'-3 attached terminal deoxyabasic moiety
  misc_feature (2)..(2): 2'-deoxy-2'-fluoro
  misc_feature (5)..(5): 2'-deoxy-2'-fluoro
  misc_feature (7)..(7): 2'-deoxy-2'-fluoro
  misc_feature (17)..(17): 2'-deoxy-2'-fluoro
  misc_feature (21)..(21): 3'-3 attached terminal deoxyabasic moiety
  misc_feature (1)..(19): ribonucleotide/modified as described
acaacaugaaaagggaugatt

SEQ ID NO: 1523 - DNA, 21 bp, Artificial Sequence
  Synthetic siNA sense region
  misc_feature (1)..(1): 5'-3 attached terminal deoxyabasic moiety
  misc_feature (5)..(5): 2'-deoxy-2'-fluoro
  misc_feature (11)..(15): 2'-deoxy-2'-fluoro
  misc_feature (17)..(17): 2'-deoxy-2'-fluoro
  misc_feature (21)..(21): 3'-3 attached terminal deoxyabasic moiety
  misc_feature (1)..(19): ribonucleotide/modified as described
gggaugaagauccucacaatt

SEQ ID NO: 1524 - DNA, 21 bp, Artificial Sequence
  Synthetic siNA sense region
  misc_feature (1)..(1): 5'-3 attached terminal deoxyabasic moiety
  misc_feature (7)..(8): 2'-deoxy-2'-fluoro
  misc_feature (11)..(11): 2'-deoxy-2'-fluoro
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
gggaaaucgaugagaaauutt

SEQ ID NO: 1525 - DNA, 21 bp, Artificial Sequence
  Synthetic siNA sense region
  misc_feature (1)..(1): 5'-3 attached terminal deoxyabasic moiety
  misc_feature (6)..(7): 2'-deoxy-2'-fluoro
  misc_feature (10)..(10): 2'-deoxy-2'-fluoro
  misc_feature (17)..(18): 2'-deoxy-2'-fluoro
  misc_feature (21)..(21): 3'-3 attached terminal deoxyabasic moiety
  misc_feature (1)..(19): ribonucleotide/modified as described
ggaaaucgaugagaaauugtt

SEQ ID NO: 1526 - DNA, 21 bp, Artificial Sequence
  Synthetic siNA sense region
  misc_feature (1)..(1): 5'-3 attached terminal deoxyabasic moiety
  misc_feature (2)..(3): 2'-deoxy-2'-fluoro
  misc_feature (5)..(7): 2'-deoxy-2'-fluoro
  misc_feature (13)..(13): 2'-deoxy-2'-fluoro
  misc_feature (15)..(17): 2'-deoxy-2'-fluoro
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
auugccuagaggugcucautt

SEQ ID NO: 1527 - DNA, 21 bp, Artificial Sequence
  Synthetic siNA antisense region
  misc_feature (2)..(4): 2'-deoxy-2'-fluoro
  misc_feature (6)..(6): 2'-deoxy-2'-fluoro
  misc_feature (10)..(12): 2'-deoxy-2'-fluoro
  misc_feature (15)..(15): 2'-deoxy-2'-fluoro
  misc_feature (17)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
gcccacagguccaguguautt

SEQ ID NO: 1528 - DNA, 21 bp, Artificial Sequence
  Synthetic siNA antisense region
  misc_feature (2)..(2): 2'-deoxy-2'-fluoro
  misc_feature (6)..(7): 2'-deoxy-2'-fluoro
  misc_feature (9)..(10): 2'-deoxy-2'-fluoro
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
gugaacugucagguuuccutt

SEQ ID NO: 1529 - DNA, 21 bp, Artificial Sequence
  Synthetic siNA antisense region
  misc_feature (1)..(1): 2'-deoxy-2'-fluoro
  misc_feature (3)..(11): 2'-deoxy-2'-fluoro
  misc_feature (13)..(13): 2'-deoxy-2'-fluoro
  misc_feature (15)..(16): 2'-deoxy-2'-fluoro
  misc_feature (18)..(18): 2'-deoxy-2'-fluoro
  misc_feature (20)..(20): Phosphorothioate 3'-Internucleotide Linkage
  misc_feature (1)..(19): ribonucleotide/modified as described
caucccuuuucauguugugtt

SEQ ID NO: 1530 - DNA, 21 bp, Artificial Sequence
  Synthetic siNA antisense region
  misc_feature (1)..(2): 2'-deoxy-2'-fluoro
  misc_feature (4)..(12): 2'-deoxy-2'-fluoro
  misc_feature (14)..(14): 2'-deoxy-2'-fluoro
  misc_feature (16)..(17): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
ucaucccuuuucauguugutt

SEQ ID NO: 1531 - DNA, 21 bp, Artificial Sequence
  Synthetic siNA antisense region
  misc_feature (1)..(2): 2'-deoxy-2'-fluoro
  misc_feature (4)..(4): 2'-deoxy-2'-fluoro
  misc_feature (10)..(14): 2'-deoxy-2'-fluoro
  misc_feature (16)..(19): 2'-deoxy-2'-fluoro
  misc_feature (20)..(20): Phosphorothioate 3'-Internucleotide Linkage
  misc_feature (1)..(19): ribonucleotide/modified as described
uugugaggaucuucauccctt

SEQ ID NO: 1532 - DNA, 21 bp, Artificial Sequence
  Synthetic siNA antisense region
  misc_feature (3)..(8): 2'-deoxy-2'-fluoro
  misc_feature (10)..(11): 2'-deoxy-2'-fluoro
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
aauuucucaucgauuuccctt

SEQ ID NO: 1533 - DNA, 21 bp, Artificial Sequence
  Synthetic siNA antisense region
  misc_feature (1)..(1): 2'-deoxy-2'-fluoro
  misc_feature (4)..(9): 2'-deoxy-2'-fluoro
  misc_feature (11)..(12): 2'-deoxy-2'-fluoro
  misc_feature (15)..(19): 2'-deoxy-2'-fluoro
  misc_feature (20)..(20): Phosphorothioate 3'-Internucleotide Linkage
  misc_feature (1)..(19): ribonucleotide/modified as described
caauuucucaucgauuucctt

SEQ ID NO: 1534 - DNA, 21 bp, Artificial Sequence
  Synthetic siNA antisense region
  misc_feature (2)..(2): 2'-deoxy-2'-fluoro
  misc_feature (6)..(6): 2'-deoxy-2'-fluoro
  misc_feature (8)..(12): 2'-deoxy-2'-fluoro
  misc_feature (16)..(16): 2'-deoxy-2'-fluoro
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
augagcaccucuaggcaautt

SEQ ID NO: 1535 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
auacacuggaccugugggctt

SEQ ID NO: 1536 - DNA, 21 bp, Artificial Sequence
  Synthetic siNA sense region
  misc_feature (1)..(1): 5'-3 attached terminal deoxyabasic moiety
  misc_feature (1)..(6): 2'-deoxy
  misc_feature (7)..(9): 2'-deoxy-2'-fluoro
  misc_feature (10)..(11): 2'-deoxy
  misc_feature (12)..(12): 2'-deoxy-2'-fluoro
  misc_feature (13)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
aggaaaccugacaguucactt

SEQ ID NO: 1537 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(17): 2'-deoxy
  misc_feature (18)..(18): 2'-deoxy-2'-fluoro
  misc_feature (19)..(19): 2'-deoxy
  misc_feature (21)..(21): 3'-3 attached terminal deoxyabasic moiety
  misc_feature (1)..(19): ribonucleotide/modified as described
cacaacaugaaaagggaugtt

SEQ ID NO: 1538 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(16): 2'-deoxy
  misc_feature (17)..(17): 2'-deoxy-2'-fluoro
  misc_feature (18)..(19): 2'-deoxy
  misc_feature (21)..(21): 3'-3 attached terminal deoxyabasic moiety
  misc_feature (1)..(19): ribonucleotide/modified as described
acaacaugaaaagggaugatt

SEQ ID NO: 1539 - DNA, 21 bp, Artificial Sequence
  Synthetic siNA sense region
  misc_feature (1)..(1): 5'-3 attached terminal deoxyabasic moiety
  misc_feature (1)..(4): 2'-deoxy
  misc_feature (5)..(5): 2'-deoxy-2'-fluoro
  misc_feature (6)..(10): 2'-deoxy
  misc_feature (11)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (21)..(21): 3'-3 attached terminal deoxyabasic moiety
  misc_feature (1)..(19): ribonucleotide/modified as described
gggaugaagauccucacaatt

SEQ ID NO: 1540 - DNA, 21 bp, Artificial Sequence
  Synthetic siNA sense region
  misc_feature (1)..(1): 5'-3 attached terminal deoxyabasic moiety
  misc_feature (1)..(6): 2'-deoxy
  misc_feature (7)..(8): 2'-deoxy-2'-fluoro
  misc_feature (9)..(10): 2'-deoxy
  misc_feature (11)..(11): 2'-deoxy-2'-fluoro
  misc_feature (12)..(17): 2'-deoxy
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
gggaaaucgaugagaaauutt

SEQ ID NO: 1541 - DNA, 21 bp, Artificial Sequence
  Synthetic siNA sense region
  misc_feature (1)..(1): 5'-3 attached terminal deoxyabasic moiety
  misc_feature (1)..(5): 2'-deoxy
  misc_feature (6)..(7): 2'-deoxy-2'-fluoro
  misc_feature (8)..(9): 2'-deoxy
  misc_feature (10)..(10): 2'-deoxy-2'-fluoro
  misc_feature (11)..(16): 2'-deoxy
  misc_feature (17)..(18): 2'-deoxy-2'-fluoro
  misc_feature (19)..(19): 2'-deoxy
  misc_feature (21)..(21): 3'-3 attached terminal deoxyabasic moiety
  misc_feature (1)..(19): ribonucleotide/modified as described
ggaaaucgaugagaaauugtt

SEQ ID NO: 1542 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy
  misc_feature (2)..(3): 2'-deoxy-2'-fluoro
  misc_feature (4)..(4): 2'-deoxy
  misc_feature (5)..(7): 2'-deoxy-2'-fluoro
  misc_feature (8)..(12): 2'-deoxy
  misc_feature (13)..(13): 2'-deoxy-2'-fluoro
  misc_feature (14)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
auugccuagaggugcucautt

SEQ ID NO: 1543 - DNA, 21 bp, Artificial Sequence
  Synthetic siNA antisense region
  misc_feature (1)..(1): 2'-deoxy
  misc_feature (2)..(4): 2'-deoxy-2'-fluoro
  misc_feature (5)..(5): 2'-deoxy
  misc_feature (6)..(6): 2'-deoxy-2'-fluoro
  misc_feature (7)..(9): 2'-deoxy
  misc_feature (10)..(12): 2'-deoxy-2'-fluoro
  misc_feature (13)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
gcccacagguccaguguautt

SEQ ID NO: 1544 - DNA, 21 bp, Artificial Sequence
  Synthetic siNA antisense region
  misc_feature (1)..(1): 2'-deoxy
  misc_feature (2)..(2): 2'-deoxy-2'-fluoro
  misc_feature (3)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(13): 2'-deoxy
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
gugaacugucagguuuccutt

SEQ ID NO: 1545 - DNA, 21 bp, Artificial Sequence
  Synthetic siNA antisense region
  misc_feature (1)..(1): 2'-deoxy-2'-fluoro
  misc_feature (2)..(2): 2'-deoxy
  misc_feature (3)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (20)..(20): Phosphorothioate 3'-Internucleotide Linkage
  misc_feature (1)..(19): ribonucleotide/modified as described
caucccuuuucauguugugtt

SEQ ID NO: 1546 - DNA, 21 bp, Artificial Sequence
  Synthetic siNA antisense region
  misc_feature (1)..(2): 2'-deoxy-2'-fluoro
  misc_feature (3)..(3): 2'-deoxy
  misc_feature (4)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
ucaucccuuuucauguugutt

SEQ ID NO: 1547 - DNA, 21 bp, Artificial Sequence
  Synthetic siNA antisense region
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(9): 2'-deoxy
  misc_feature (10)..(14): 2'-deoxy-2'-fluoro
  misc_feature (15)..(15): 2'-deoxy
  misc_feature (16)..(19): 2'-deoxy-2'-fluoro
  misc_feature (20)..(20): Phosphorothioate 3'-Internucleotide Linkage
  misc_feature (1)..(19): ribonucleotide/modified as described
uugugaggaucuucauccctt

SEQ ID NO: 1548 - DNA, 21 bp, Artificial Sequence
  Synthetic siNA antisense region
  misc_feature (1)..(2): 2'-deoxy
  misc_feature (3)..(8): 2'-deoxy-2'-fluoro
  misc_feature (9)..(9): 2'-deoxy
  misc_feature (10)..(11): 2'-deoxy-2'-fluoro
  misc_feature (12)..(13): 2'-deoxy
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
aauuucucaucgauuuccctt

SEQ ID NO: 1549 - DNA, 21 bp, Artificial Sequence
  Synthetic siNA antisense region
  misc_feature (1)..(1): 2'-deoxy-2'-fluoro
  misc_feature (2)..(3): 2'-deoxy
  misc_feature (4)..(9): 2'-deoxy-2'-fluoro
  misc_feature (10)..(10): 2'-deoxy
  misc_feature (11)..(12): 2'-deoxy-2'-fluoro
  misc_feature (13)..(14): 2'-deoxy
  misc_feature (15)..(19): 2'-deoxy-2'-fluoro
  misc_feature (20)..(20): Phosphorothioate 3'-Internucleotide Linkage
  misc_feature (1)..(19): ribonucleotide/modified as described
caauuucucaucgauuucctt

SEQ ID NO: 1550 - DNA, 21 bp, Artificial Sequence
  Synthetic siNA antisense region
  misc_feature (1)..(1): 2'-deoxy
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(12): 2'-deoxy-2'-fluoro
  misc_feature (13)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
augagcaccucuaggcaautt

SEQ ID NO: 1551 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(2): 2'-deoxy-2'-fluoro
  misc_feature (3)..(3): 2'-O-methyl
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(10): 2'-O-methyl
  misc_feature (11)..(13): 2'-deoxy-2'-fluoro
  misc_feature (14)..(14): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
auacacuggaccugugggctt

SEQ ID NO: 1552 - DNA, 21 bp, Artificial Sequence
  Synthetic siNA sense region
  misc_feature (1)..(1): 5'-3 attached terminal deoxyabasic moiety
  misc_feature (2)..(6): 2'-O-methyl
  misc_feature (7)..(9): 2'-deoxy-2'-fluoro
  misc_feature (10)..(11): 2'-O-methyl
  misc_feature (12)..(12): 2'-deoxy-2'-fluoro
  misc_feature (13)..(14): 2'-O-methyl
  misc_feature (15)..(17): 2'-deoxy-2'-fluoro
  misc_feature (16)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
aggaaaccugacaguucactt

SEQ ID NO: 1553 - DNA, 21 bp, Artificial Sequence
  Synthetic siNA sense region
  misc_feature (1)..(1): 5'-3 attached terminal deoxyabasic moiety
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(17): 2'-O-methyl
  misc_feature (18)..(18): 2'-deoxy-2'-fluoro
  misc_feature (21)..(21): 3'-3 attached terminal deoxyabasic moiety
  misc_feature (1)..(19): ribonucleotide/modified as described
cacaacaugaaaagggaugtt

SEQ ID NO: 1554 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(16): 2'-O-methyl
  misc_feature (17)..(17): 2'-deoxy-2'-fluoro
  misc_feature (18)..(19): 2'-O-methyl
  misc_feature (21)..(21): 3'-3 attached terminal deoxyabasic moiety
  misc_feature (1)..(19): ribonucleotide/modified as described
acaacaugaaaagggaugatt

SEQ ID NO: 1555 - DNA, 21 bp, Artificial Sequence
  Synthetic siNA sense region
  misc_feature (1)..(1): 5'-3 attached terminal deoxyabasic moiety
  misc_feature (1)..(4): 2'-O-methyl
  misc_feature (5)..(5): 2'-deoxy-2'-fluoro
  misc_feature (6)..(10): 2'-O-methyl
  misc_feature (11)..(15): 2'-deoxy-2'-fluoro
  misc_feature (16)..(16): 2'-O-methyl
  misc_feature (17)..(17): 2'-deoxy-2'-fluoro
  misc_feature (18)..(19): 2'-O-methyl
  misc_feature (21)..(21): 3'-3 attached terminal deoxyabasic moiety
  misc_feature (1)..(19): ribonucleotide/modified as described
gggaugaagauccucacaatt

SEQ ID NO: 1556 - DNA, 21 bp, Artificial Sequence
  Synthetic siNA sense region
  misc_feature (1)..(1): 5'-3 attached terminal deoxyabasic moiety
  misc_feature (1)..(6): 2'-O-methyl
  misc_feature (7)..(8): 2'-deoxy-2'-fluoro
  misc_feature (9)..(10): 2'-O-methyl
  misc_feature (11)..(11): 2'-deoxy-2'-fluoro
  misc_feature (12)..(17): 2'-O-methyl
  misc_feature (18)..(19): 2'-deoxy-2'-fluoro
  misc_feature (21)..(21): 3'-3 attached terminal deoxyabasic moiety
  misc_feature (1)..(19): ribonucleotide/modified as described
gggaaaucgaugagaaauutt

SEQ ID NO: 1557 - DNA, 21 bp, Artificial Sequence
  Synthetic siNA sense region
  misc_feature (1)..(1): 5'-3 attached terminal deoxyabasic moiety
  misc_feature (1)..(5): 2'-O-methyl
  misc_feature (6)..(7): 2'-deoxy-2'-fluoro
  misc_feature (8)..(9): 2'-O-methyl
  misc_feature (10)..(10): 2'-deoxy-2'-fluoro
  misc_feature (11)..(16): 2'-O-methyl
  misc_feature (17)..(18): 2'-deoxy-2'-fluoro
  misc_feature (19)..(19): 2'-O-methyl
  misc_feature (21)..(21): 3'-3 attached terminal deoxyabasic moiety
  misc_feature (1)..(19): ribonucleotide/modified as described
ggaaaucgaugagaaauugtt

SEQ ID NO: 1558 - DNA, 21 bp, Artificial Sequence
  Synthetic siNA sense region
  misc_feature (1)..(1): 5'-3 attached terminal deoxyabasic moiety
  misc_feature (1)..(1): 2'-O-methyl
  misc_feature (2)..(3): 2'-deoxy-2'-fluoro
  misc_feature (4)..(4): 2'-O-methyl
  misc_feature (5)..(7): 2'-deoxy-2'-fluoro
  misc_feature (8)..(12): 2'-O-methyl
  misc_feature (13)..(13): 2'-deoxy-2'-fluoro
  misc_feature (14)..(14): 2'-O-methyl
  misc_feature (15)..(17): 2'-deoxy-2'-fluoro
  misc_feature (16)..(18): 2'-O-methyl
  misc_feature (19)..(19): 2'-deoxy-2'-fluoro
  misc_feature (21)..(21): 3'-3 attached terminal deoxyabasic moiety
  misc_feature (1)..(19): ribonucleotide/modified as described
auugccuagaggugcucautt

SEQ ID NO: 1559 - DNA, 21 bp, Artificial Sequence
  Synthetic siNA antisense region
  misc_feature (1)..(1): 2'-O-methyl
  misc_feature (2)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(12): 2'-deoxy-2'-fluoro
  misc_feature (13)..(14): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
gcccacagguccaguguautt

SEQ ID NO: 1560 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(5): 2'-O-methyl
  misc_feature (6)..(7): 2'-deoxy-2'-fluoro
  misc_feature (8)..(8): 2'-O-methyl
  misc_feature (9)..(10): 2'-deoxy-2'-fluoro
  misc_feature (11)..(13): 2'-O-methyl
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
gugaacugucagguuuccutt

SEQ ID NO: 1561 - DNA, 21 bp, Artificial Sequence
  Synthetic siNA antisense region
  misc_feature (1)..(1): 2'-deoxy-2'-fluoro
  misc_feature (2)..(2): 2'-O-methyl
  misc_feature (3)..(11): 2'-deoxy-2'-fluoro
  misc_feature (12)..(12): 2'-O-methyl
  misc_feature (13)..(13): 2'-deoxy-2'-fluoro
  misc_feature (14)..(14): 2'-O-methyl
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(19): 2'-O-methyl
  misc_feature (20)..(20): Phosphorothioate 3'-Internucleotide Linkage
  misc_feature (1)..(19): ribonucleotide/modified as described
caucccuuuucauguugugtt

SEQ ID NO: 1562 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
ucaucccuuuucauguugutt

SEQ ID NO: 1563 - DNA, 21 bp, Artificial Sequence
  Synthetic siNA antisense region
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(9): 2'-O-methyl
  misc_feature (10)..(14): 2'-deoxy-2'-fluoro
  misc_feature (15)..(15): 2'-O-methyl
  misc_feature (16)..(19): 2'-deoxy-2'-fluoro
  misc_feature (20)..(20): Phosphorothioate 3'-Internucleotide Linkage
  misc_feature (1)..(19): ribonucleotide/modified as described
uugugaggaucuucauccctt

SEQ ID NO: 1564 - DNA, 21 bp, Artificial Sequence
  Synthetic siNA antisense region
  misc_feature (1)..(2): 2'-O-methyl
  misc_feature (3)..(8): 2'-deoxy-2'-fluoro
  misc_feature (9)..(9): 2'-O-methyl
  misc_feature (10)..(11): 2'-deoxy-2'-fluoro
  misc_feature (12)..(13): 2'-O-methyl
  misc_feature (14)..(19): 2'-deoxy-2'-fluoro
  misc_feature (20)..(20): Phosphorothioate 3'-Internucleotide Linkage
  misc_feature (1)..(19): ribonucleotide/modified as described
aauuucucaucgauuuccctt

SEQ ID NO: 1565 - DNA, 21 bp, Artificial Sequence
  Synthetic siNA antisense region
  misc_feature (1)..(1): 2'-deoxy-2'-fluoro
  misc_feature (2)..(3): 2'-O-methyl
  misc_feature (4)..(9): 2'-deoxy-2'-fluoro
  misc_feature (10)..(10): 2'-O-methyl
  misc_feature (11)..(12): 2'-deoxy-2'-fluoro
  misc_feature (13)..(14): 2'-O-methyl
  misc_feature (15)..(19): 2'-deoxy-2'-fluoro
  misc_feature (20)..(20): Phosphorothioate 3'-Internucleotide Linkage
  misc_feature (1)..(19): ribonucleotide/modified as described
caauuucucaucgauuucctt

SEQ ID NO: 1566 - DNA, 21 bp, Artificial Sequence
  Synthetic siNA antisense region
  misc_feature (1)..(1): 2'-O-methyl
  misc_feature (2)..(2): 2'-deoxy-2'-fluoro
  misc_feature (3)..(5): 2'-O-methyl
  misc_feature (6)..(6): 2'-deoxy-2'-fluoro
  misc_feature (7)..(7): 2'-O-methyl
  misc_feature (8)..(12): 2'-deoxy-2'-fluoro
  misc_feature (13)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(20): Phosphorothioate 3'-Internucleotide Linkage
  misc_feature (1)..(19): ribonucleotide/modified as described
augagcaccucuaggcaautt

SEQ ID NO: 1567 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
auacacuggaccugugggctt

SEQ ID NO: 1568 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
aggaaaccugacaguucactt

SEQ ID NO: 1569 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide/modified as described
cacaacaugaaaagggaugtt

SEQ ID NO: 1570 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
acaacaugaaaagggaugatt

SEQ ID NO: 1571 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gggaugaagauccucacaatt

SEQ ID NO: 1572 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gggaaaucgaugagaaauutt

SEQ ID NO: 1573 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ggaaaucgaugagaaauugtt

SEQ ID NO: 1574 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
auugccuagaggugcucautt

SEQ ID NO: 1575 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcccacagguccaguguautt

SEQ ID NO: 1576 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gugaacugucagguuuccutt

SEQ ID NO: 1577 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caucccuuuucauguugugtt

SEQ ID NO: 1578 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucaucccuuuucauguugutt

SEQ ID NO: 1579 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uugugaggaucuucauccctt

SEQ ID NO: 1580 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aauuucucaucgauuuccctt

SEQ ID NO: 1581 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caauuucucaucgauuucctt

SEQ ID NO: 1582 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
augagcaccucuaggcaautt

SEQ ID NO: 1583 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gcccacagguccaguguautt

SEQ ID NO: 1584 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gugaacugucagguuuccutt

SEQ ID NO: 1585 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caucccuuuucauguugugtt

SEQ ID NO: 1586 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ucaucccuuuucauguugutt

SEQ ID NO: 1587 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
uugugaggaucuucauccctt

SEQ ID NO: 1588 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
aauuucucaucgauuuccctt

SEQ ID NO: 1589 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caauuucucaucgauuucctt

SEQ ID NO: 1590 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
augagcaccucuaggcaautt

SEQ ID NO: 1591 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gcccacagguccaguguautt

SEQ ID NO: 1592 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gugaacugucagguuuccutt

SEQ ID NO: 1593 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caucccuuuucauguugugtt

SEQ ID NO: 1594 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ucaucccuuuucauguugutt

SEQ ID NO: 1595 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
uugugaggaucuucauccctt

SEQ ID NO: 1596 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
aauuucucaucgauuuccctt

SEQ ID NO: 1597 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caauuucucaucgauuucctt

SEQ ID NO: 1598 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
augagcaccucuaggcaautt

SEQ ID NO: 1599 - DNA, 21 bp, Artificial Sequence
  Synthetic siNA sense region
  misc_feature (1)..(19): ribonucleotide/modified as described
caguuuguaaaggaccugctt

SEQ ID NO: 1600 - DNA, 21 bp, Artificial Sequence
  Synthetic siNA sense region
  misc_feature (1)..(19): ribonucleotide/modified as described
cuucacacacaggcaacugtt

SEQ ID NO: 1601 - DNA, 21 bp, Artificial Sequence
  Synthetic siNA sense region
  misc_feature (1)..(19): ribonucleotide/modified as described
aggcacacuucuucuuggutt

SEQ ID NO: 1602 - DNA, 21 bp, Artificial Sequence
  Synthetic siNA sense region
  misc_feature (1)..(19): ribonucleotide/modified as described
gacuguggcugcuagcacutt

SEQ ID NO: 1603 - DNA, 21 bp, Artificial Sequence
  Synthetic siNA sense region
  misc_feature (1)..(19): ribonucleotide/modified as described
cacuaaagcaguggacacctt

SEQ ID NO: 1604 - DNA, 21 bp, Artificial Sequence
  Synthetic siNA sense region
  misc_feature (1)..(19): ribonucleotide/modified as described
cuaaagcaguggacaccagtt

SEQ ID NO: 1605 - DNA, 21 bp, Artificial Sequence
  Synthetic siNA sense region
  misc_feature (1)..(19): ribonucleotide/modified as described
aagcaguggacaccaggagtt

SEQ ID NO: 1606 - DNA, 21 bp, Artificial Sequence
  Synthetic siNA sense region
  misc_feature (1)..(19): ribonucleotide/modified as described
aaggguaccuugaacacugtt

SEQ ID NO: 1607 - DNA, 21 bp, Artificial Sequence
  Synthetic siNA antisense region
  misc_feature (1)..(19): ribonucleotide/modified as described
gcagguccuuuacaaacugtt

SEQ ID NO: 1608 - DNA, 21 bp, Artificial Sequence
  Synthetic siNA antisense region
  misc_feature (1)..(19): ribonucleotide/modified as described
caguugccugugugugaagtt

SEQ ID NO: 1609 - DNA, 21 bp, Artificial Sequence
  Synthetic siNA antisense region
  misc_feature (1)..(19): ribonucleotide/modified as described
accaagaagaagugugccutt

SEQ ID NO: 1610 - DNA, 21 bp, Artificial Sequence
  Synthetic siNA antisense region
  misc_feature (1)..(19): ribonucleotide/modified as described
agugcuagcagccacaguctt

SEQ ID NO: 1611 - DNA, 21 bp, Artificial Sequence
  Synthetic siNA antisense region
  misc_feature (1)..(19): ribonucleotide/modified as described
gguguccacugcuuuagugtt

SEQ ID NO: 1612 - DNA, 21 bp, Artificial Sequence
  Synthetic siNA antisense region
  misc_feature (1)..(19): ribonucleotide/modified as described
cugguguccacugcuuuagtt

SEQ ID NO: 1613 - DNA, 21 bp, Artificial Sequence
  Synthetic siNA antisense region
  misc_feature (1)..(19): ribonucleotide/modified as described
cuccugguguccacugcuutt

SEQ ID NO: 1614 - DNA, 21 bp, Artificial Sequence
  Synthetic siNA antisense region
  misc_feature (1)..(19): ribonucleotide/modified as described
caguguucaagguacccuutt

SEQ ID NO: 1615 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
caguuuguaaaggaccugctt

SEQ ID NO: 1616 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuucacacacaggcaacugtt

SEQ ID NO: 1617 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aggcacacuucuucuuggutt

SEQ ID NO: 1618 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gacuguggcugcuagcacutt

SEQ ID NO: 1619 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cacuaaagcaguggacacctt

SEQ ID NO: 1620 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuaaagcaguggacaccagtt

SEQ ID NO: 1621 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagcaguggacaccaggagtt

SEQ ID NO: 1622 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaggguaccuugaacacugtt

SEQ ID NO: 1623 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcagguccuuuacaaacugtt

SEQ ID NO: 1624 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguugccugugugugaagtt

SEQ ID NO: 1625 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
accaagaagaagugugccutt

SEQ ID NO: 1626 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agugcuagcagccacaguctt

SEQ ID NO: 1627 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gguguccacugcuuuagugtt

SEQ ID NO: 1628 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cugguguccacugcuuuagtt

SEQ ID NO: 1629 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cuccugguguccacugcuutt

SEQ ID NO: 1630 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguguucaagguacccuutt

SEQ ID NO: 1631 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uuguguguuauuuaaaugatt

SEQ ID NO: 1632 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uguguguuauuuaaaugagtt

SEQ ID NO: 1633 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
guguguuauuuaaaugagutt

SEQ ID NO: 1634 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
auuguguguuauuuaaaugtt

SEQ ID NO: 1635 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
caauggcagcaugguauggtt

SEQ ID NO: 1636 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aauggcagcaugguauggatt

SEQ ID NO: 1637 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
auggcagcaugguauggagtt

SEQ ID NO: 1638 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
auuauuguguguuauuuaatt

SEQ ID NO: 1639 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uuauuguguguuauuuaaatt

SEQ ID NO: 1640 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uauuguguguuauuuaaautt

SEQ ID NO: 1641 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
caguuuguaaaggaccugctt

SEQ ID NO: 1642 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuucacacacaggcaacugtt

SEQ ID NO: 1643 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aggcacacuucuucuuggutt

SEQ ID NO: 1644 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gacuguggcugcuagcacutt

SEQ ID NO: 1645 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cacuaaagcaguggacacctt

SEQ ID NO: 1646 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuaaagcaguggacaccagtt

SEQ ID NO: 1647 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagcaguggacaccaggagtt

SEQ ID NO: 1648 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaggguaccuugaacacugtt

SEQ ID NO: 1649 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcagguccuuuacaaacugtt

SEQ ID NO: 1650 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguugccugugugugaagtt

SEQ ID NO: 1651 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
accaagaagaagugugccutt

SEQ ID NO: 1652 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agugcuagcagccacaguctt

SEQ ID NO: 1653 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gguguccacugcuuuagugtt

SEQ ID NO: 1654 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cugguguccacugcuuuagtt

SEQ ID NO: 1655 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cuccugguguccacugcuutt

SEQ ID NO: 1656 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguguucaagguacccuutt

SEQ ID NO: 1657 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
caguuuguaaaggaccugctt

SEQ ID NO: 1658 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuucacacacaggcaacugtt

SEQ ID NO: 1659 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aggcacacuucuucuuggutt

SEQ ID NO: 1660 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gacuguggcugcuagcacutt

SEQ ID NO: 1661 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cacuaaagcaguggacacctt

SEQ ID NO: 1662 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuaaagcaguggacaccagtt

SEQ ID NO: 1663 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagcaguggacaccaggagtt

SEQ ID NO: 1664 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaggguaccuugaacacugtt

SEQ ID NO: 1665 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucauuuaaauaacacacaatt

SEQ ID NO: 1666 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cucauuuaaauaacacacatt

SEQ ID NO: 1667 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
acucauuuaaauaacacactt

SEQ ID NO: 1668 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cauuuaaauaacacacaautt

SEQ ID NO: 1669 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ccauaccaugcugccauugtt

SEQ ID NO: 1670 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uccauaccaugcugccauutt

SEQ ID NO: 1671 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cuccauaccaugcugccautt

SEQ ID NO: 1672 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uuaaauaacacacaauaautt

SEQ ID NO: 1673 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uuuaaauaacacacaauaatt

SEQ ID NO: 1674 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
auuuaaauaacacacaauatt

SEQ ID NO: 1675 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcagguccuuuacaaacugtt

SEQ ID NO: 1676 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguugccugugugugaagtt

SEQ ID NO: 1677 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
accaagaagaagugugccutt

SEQ ID NO: 1678 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agugcuagcagccacaguctt

SEQ ID NO: 1679 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gguguccacugcuuuagugtt

SEQ ID NO: 1680 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cugguguccacugcuuuagtt

SEQ ID NO: 1681 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cuccugguguccacugcuutt

SEQ ID NO: 1682 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguguucaagguacccuutt

SEQ ID NO: 1683 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
caguuuguaaaggaccugctt

SEQ ID NO: 1684 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cuucacacacaggcaacugtt

SEQ ID NO: 1685 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aggcacacuucuucuuggutt

SEQ ID NO: 1686 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gacuguggcugcuagcacutt

SEQ ID NO: 1687 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
cacuaaagcaguggacacctt

SEQ ID NO: 1688 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
cuaaagcaguggacaccagtt

SEQ ID NO: 1689 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagcaguggacaccaggagtt

SEQ ID NO: 1690 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaggguaccuugaacacugtt

SEQ ID NO: 1691 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gcagguccuuuacaaacugtt

SEQ ID NO: 1692 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguugccugugugugaagtt

SEQ ID NO: 1693 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
accaagaagaagugugccutt

SEQ ID NO: 1694 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agugcuagcagccacaguctt

SEQ ID NO: 1695 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
gguguccacugcuuuagugtt

SEQ ID NO: 1696 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cugguguccacugcuuuagtt

SEQ ID NO: 1697 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cuccugguguccacugcuutt

SEQ ID NO: 1698 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
caguguucaagguacccuutt

SEQ ID NO: 1699 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gcagguccuuuacaaacugtt

SEQ ID NO: 1700 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caguugccugugugugaagtt

SEQ ID NO: 1701 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
accaagaagaagugugccutt

SEQ ID NO: 1702 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
agugcuagcagccacaguctt

SEQ ID NO: 1703 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gguguccacugcuuuagugtt

SEQ ID NO: 1704 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
cugguguccacugcuuuagtt

SEQ ID NO: 1705 - DNA, 21 bp, Artificial Sequence
  Synthetic siNA antisense region
  misc_feature (21)..(21): 3'-3 attached terminal deoxyabasic moiety
  misc_feature (1)..(19): ribonucleotide/modified as described
cuccugguguccacugcuutt

SEQ ID NO: 1706 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caguguucaagguacccuutt

SEQ ID NO: 1707 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gcagguccuuuacaaacugtt

SEQ ID NO: 1708 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caguugccugugugugaagtt

SEQ ID NO: 1709 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
accaagaagaagugugccutt

SEQ ID NO: 1710 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
agugcuagcagccacaguctt

SEQ ID NO: 1711 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
gguguccacugcuuuagugtt

SEQ ID NO: 1712 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
cugguguccacugcuuuagtt

SEQ ID NO: 1713 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
cuccugguguccacugcuutt

SEQ ID NO: 1714 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
caguguucaagguacccuutt

SEQ ID NO: 1715 - DNA, 21 bp, Artificial Sequence
  Synthetic siNA sense region
  misc_feature (1)..(19): ribonucleotide/modified as described
ggugauccugagucugcugtt

SEQ ID NO: 1716 - DNA, 21 bp, Artificial Sequence
  Synthetic siNA sense region
  misc_feature (1)..(19): ribonucleotide/modified as described
gucaaggauaaugcaggaatt

SEQ ID NO: 1717 - DNA, 21 bp, Artificial Sequence
  Synthetic siNA sense region
  misc_feature (1)..(19): ribonucleotide/modified as described
uccaagaggcuaaaugugatt

SEQ ID NO: 1718 - DNA, 21 bp, Artificial Sequence
  Synthetic siNA sense region
  misc_feature (1)..(19): ribonucleotide/modified as described
aaaccgacucuguagugcutt

SEQ ID NO: 1719 - DNA, 21 bp, Artificial Sequence
  Synthetic siNA sense region
  misc_feature (1)..(19): ribonucleotide/modified as described
aagaaagccucucagugautt

SEQ ID NO: 1720 - DNA, 21 bp, Artificial Sequence
  Synthetic siNA sense region
  misc_feature (1)..(19): ribonucleotide/modified as described
ugcaccauuuaaaaacaggtt

SEQ ID NO: 1721 - DNA, 21 bp, Artificial Sequence
  Synthetic siNA sense region
  misc_feature (1)..(19): ribonucleotide/modified as described
gcauuuuccucugcuuugatt

SEQ ID NO: 1722 - DNA, 21 bp, Artificial Sequence
  Synthetic siNA sense region
  misc_feature (1)..(19): ribonucleotide/modified as described
aagaccuuucaaagccauutt

SEQ ID NO: 1723 - DNA, 21 bp, Artificial Sequence
  Synthetic siNA antisense region
  misc_feature (1)..(19): ribonucleotide/modified as described
cagcagacucaggaucacctt

SEQ ID NO: 1724 - DNA, 21 bp, Artificial Sequence
  Synthetic siNA antisense region
  misc_feature (1)..(19): ribonucleotide/modified as described
uuccugcauuauccuugactt

SEQ ID NO: 1725 - DNA, 21 bp, Artificial Sequence
  Synthetic siNA antisense region
  misc_feature (1)..(19): ribonucleotide/modified as described
ucacauuuagccucuuggatt

SEQ ID NO: 1726 - DNA, 21 bp, Artificial Sequence
  Synthetic siNA antisense region
  misc_feature (1)..(19): ribonucleotide/modified as described
agcacuacagagucgguuutt

SEQ ID NO: 1727 - DNA, 21 bp, Artificial Sequence
  Synthetic siNA antisense region
  misc_feature (1)..(19): ribonucleotide/modified as described
aucacugagaggcuuucuutt

SEQ ID NO: 1728 - DNA, 21 bp, Artificial Sequence
  Synthetic siNA antisense region
  misc_feature (1)..(19): ribonucleotide/modified as described
ccuguuuuuaaauggugcatt

SEQ ID NO: 1729 - DNA, 21 bp, Artificial Sequence
  Synthetic siNA antisense region
  misc_feature (1)..(19): ribonucleotide/modified as described
ucaaagcagaggaaaaugctt

SEQ ID NO: 1730 - DNA, 21 bp, Artificial Sequence
  Synthetic siNA antisense region
  misc_feature (1)..(19): ribonucleotide/modified as described
aauggcuuugaaaggucuutt

SEQ ID NO: 1731 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ggugauccugagucugcugtt

SEQ ID NO: 1732 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gucaaggauaaugcaggaatt

SEQ ID NO: 1733 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uccaagaggcuaaaugugatt

SEQ ID NO: 1734 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaaccgacucuguagugcutt

SEQ ID NO: 1735 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaaagccucucagugautt

SEQ ID NO: 1736 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ugcaccauuuaaaaacaggtt

SEQ ID NO: 1737 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gcauuuuccucugcuuugatt

SEQ ID NO: 1738 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaccuuucaaagccauutt

SEQ ID NO: 1739 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cagcagacucaggaucacctt

SEQ ID NO: 1740 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uuccugcauuauccuugactt

SEQ ID NO: 1741 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucacauuuagccucuuggatt

SEQ ID NO: 1742 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agcacuacagagucgguuutt

SEQ ID NO: 1743 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aucacugagaggcuuucuutt

SEQ ID NO: 1744 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ccuguuuuuaaauggugcatt

SEQ ID NO: 1745 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucaaagcagaggaaaaugctt

SEQ ID NO: 1746 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aauggcuuugaaaggucuutt

SEQ ID NO: 1747 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ggugauccugagucugcugtt

SEQ ID NO: 1748 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gucaaggauaaugcaggaatt

SEQ ID NO: 1749 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uccaagaggcuaaaugugatt

SEQ ID NO: 1750 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaaccgacucuguagugcutt

SEQ ID NO: 1751 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaaagccucucagugautt

SEQ ID NO: 1752 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ugcaccauuuaaaaacaggtt

SEQ ID NO: 1753 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gcauuuuccucugcuuugatt

SEQ ID NO: 1754 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaccuuucaaagccauutt

SEQ ID NO: 1755 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cagcagacucaggaucacctt

SEQ ID NO: 1756 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uuccugcauuauccuugactt

SEQ ID NO: 1757 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucacauuuagccucuuggatt

SEQ ID NO: 1758 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agcacuacagagucgguuutt

SEQ ID NO: 1759 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aucacugagaggcuuucuutt

SEQ ID NO: 1760 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ccuguuuuuaaauggugcatt

SEQ ID NO: 1761 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucaaagcagaggaaaaugctt

SEQ ID NO: 1762 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aauggcuuugaaaggucuutt

SEQ ID NO: 1763 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ggugauccugagucugcugtt

SEQ ID NO: 1764 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gucaaggauaaugcaggaatt

SEQ ID NO: 1765 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uccaagaggcuaaaugugatt

SEQ ID NO: 1766 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaaccgacucuguagugcutt

SEQ ID NO: 1767 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaaagccucucagugautt

SEQ ID NO: 1768 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ugcaccauuuaaaaacaggtt

SEQ ID NO: 1769 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gcauuuuccucugcuuugatt

SEQ ID NO: 1770 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaccuuucaaagccauutt

SEQ ID NO: 1771 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cagcagacucaggaucacctt

SEQ ID NO: 1772 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uuccugcauuauccuugactt

SEQ ID NO: 1773 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucacauuuagccucuuggatt

SEQ ID NO: 1774 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agcacuacagagucgguuutt

SEQ ID NO: 1775 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aucacugagaggcuuucuutt

SEQ ID NO: 1776 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ccuguuuuuaaauggugcatt

SEQ ID NO: 1777 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucaaagcagaggaaaaugctt

SEQ ID NO: 1778 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aauggcuuugaaaggucuutt

SEQ ID NO: 1779 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ggugauccugagucugcugtt

SEQ ID NO: 1780 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gucaaggauaaugcaggaatt

SEQ ID NO: 1781 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
uccaagaggcuaaaugugatt

SEQ ID NO: 1782 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aaaccgacucuguagugcutt

SEQ ID NO: 1783 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaaagccucucagugautt

SEQ ID NO: 1784 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
ugcaccauuuaaaaacaggtt

SEQ ID NO: 1785 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
gcauuuuccucugcuuugatt

SEQ ID NO: 1786 - DNA, 21 bp, Artificial Sequence
  Synthetic siNA sense region
  misc_feature (1)..(1): 5'-3 attached terminal deoxyabasic moiety
  misc_feature (1)..(19): ribonucleotide/modified as described
  misc_feature (21)..(21): 3'-3 attached terminal deoxyabasic moiety
aagaccuuucaaagccauutt

SEQ ID NO: 1787 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
cagcagacucaggaucacctt

SEQ ID NO: 1788 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
uuccugcauuauccuugactt

SEQ ID NO: 1789 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucacauuuagccucuuggatt

SEQ ID NO: 1790 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
agcacuacagagucgguuutt

SEQ ID NO: 1791 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aucacugagaggcuuucuutt

SEQ ID NO: 1792 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ccuguuuuuaaauggugcatt

SEQ ID NO: 1793 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
ucaaagcagaggaaaaugctt

SEQ ID NO: 1794 - DNA, 21 bp, Artificial Sequence
  Synthetic siNA antisense region
  misc_feature (20)..(20): Phosphorothioate 3'-Internucleotide Linkage
  misc_feature (1)..(19): ribonucleotide/modified as described
aauggcuuugaaaggucuutt

SEQ ID NO: 1795 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
cagcagacucaggaucacctt

SEQ ID NO: 1796 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
uuccugcauuauccuugactt

SEQ ID NO: 1797 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ucacauuuagccucuuggatt

SEQ ID NO: 1798 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
agcacuacagagucgguuutt

SEQ ID NO: 1799 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
aucacugagaggcuuucuutt

SEQ ID NO: 1800 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ccuguuuuuaaauggugcatt

SEQ ID NO: 1801 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ucaaagcagaggaaaaugctt

SEQ ID NO: 1802 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
aauggcuuugaaaggucuutt

SEQ ID NO: 1803 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
cagcagacucaggaucacctt

SEQ ID NO: 1804 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
uuccugcauuauccuugactt

SEQ ID NO: 1805 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ucacauuuagccucuuggatt

SEQ ID NO: 1806 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
agcacuacagagucgguuutt

SEQ ID NO: 1807 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
aucacugagaggcuuucuutt

SEQ ID NO: 1808 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ccuguuuuuaaauggugcatt

SEQ ID NO: 1809 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
ucaaagcagaggaaaaugctt

SEQ ID NO: 1810 - DNA, 21 bp, Artificial Sequence
  Synthetic siNA antisense region
  misc_feature (1)..(19): ribonucleotide/modified as described
  misc_feature (21)..(21): 3'-3 attached terminal deoxyabasic moiety
aauggcuuugaaaggucuutt

SEQ ID NO: 1811 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): n stands for any ribonucleotide
  misc_feature (20)..(21): n stands for any nucleotide
nnnnnnnnnnnnnnnnnnnnn

SEQ ID NO: 1812 - DNA, 21 bp, Artificial Sequence
  Synthetic siNA antisense region
  misc_feature (20)..(20): Phosphorothioate 3'-Internucleotide Linkage
  misc_feature (1)..(19): n stands for any ribonucleotide
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1813 - DNA, 21 bp, Artificial Sequence
  Synthetic siNA sense region
  misc_feature (1)..(19): n stands for any ribonucleotide wherein any pyrimidine nucleotide present is 2'-Fluoro and all purine nucleotide is 2'-o-methly
  misc_feature (20)..(20): Phosphorothioate 3'-Internucleotide Linkage
  misc_feature (20)..(21): n stands for any nucleotide
nnnnnnnnnnnnnnnnnnnnn

SEQ ID NO: 1814 - DNA, 21 bp, Artificial Sequence
  Synthetic siNA antisense region
  misc_feature (1)..(19): n stands for any ribonucleotide wherein any pyrimidine nucleotide present is 2'-Fluoro and all purine nucleotides are 2'-o-methyl
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1815 - DNA, 21 bp, Artificial Sequence
  Synthetic siNA sense region
  misc_feature (1)..(19): n stands for any ribonucleotide wherein any pyrimidine nucleotide present is 2'-O-methyl or 2'-Fluoro
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 1816 - DNA, 21 bp, Artificial Sequence
  Synthetic siNA antisense region
  misc_feature (1)..(19): n stands for any ribonucleotide wherein any pyrimidine nucleotide present is 2'-Fluoro
  misc_feature (20)..(20): Phosphorothioate 3'-Internucleotide Linkage
  misc_feature (20)..(21): n stands for any nucleotide
  misc_feature (21)..(21): 3'-3 attached terminal glyceryl moiety
nnnnnnnnnnnnnnnnnnnnn

SEQ ID NO: 1817 - DNA, 21 bp, Artificial Sequence
  Synthetic siNA sense region
  misc_feature (1)..(19): n stands for any ribonucleotide wherein any pyrimidine nucleotide present is 2'-Fluoro and any purine nucleotide present is 2'-Deoxy
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 1818 - DNA, 21 bp, Artificial Sequence
  Synthetic siNA sense region
  misc_feature (1)..(19): n stands for any ribonucleotide wherein any pyrimidine nucleotide present is 2'-Fluoro
  misc_feature (20)..(21): n stands for any nucleotide
  misc_feature (1)..(1): 5'-3 attached terminal deoxyabasic moiety
  misc_feature (21)..(21): 3'-3 attached terminal deoxyabasic moiety
nnnnnnnnnnnnnnnnnnnnn

SEQ ID NO: 1819 - DNA, 21 bp, Artificial Sequence
  Synthetic siNA antisense region
  misc_feature (1)..(19): n stands for any ribonucleotide wherein any pyrimidine nucleotide present is 2'-Fluoro and any purine nucleotide present is 2'-deoxy
  misc_feature (20)..(21): n stands for any nucleotide
  misc_feature (20)..(20): Phosphorothioate or Phosphorodithioate 3'-Internucleotide Linkage
  misc_feature (21)..(21): 3'-3 attached terminal glyceryl moiety
nnnnnnnnnnnnnnnnnnnnn

SEQ ID NO: 1820 - DNA, 21 bp, Artificial Sequence
  Synthetic siNA sense region
  misc_feature (1)..(1): 5'-3 attached terminal deoxyabasic moiety
  misc_feature (21)..(21): 3'-3 attached terminal deoxyabasic moiety
  misc_feature (1)..(19): ribonucleotide modified as described
cagugauggugaaauuccutt

SEQ ID NO: 1821 - DNA, 21 bp, Artificial Sequence
  Synthetic siNA antisense region
  misc_feature (20)..(20): Phosphorothioate or Phosphorodithioate 3'-Internucleotide Linkage
  misc_feature (21)..(21): 3'-3 attached terminal glyceryl moiety
aggaauuucaccaucacugtt

SEQ ID NO: 1822 - DNA, 21 bp, Artificial Sequence
  Synthetic siNA sense region
  misc_feature (3)..(3): 2'-O-Methyl
  misc_feature (5)..(6): 2'-O-Methyl
  misc_feature (8)..(9): 2'-O-Methyl
  misc_feature (11)..(14): 2'-O-Methyl
  misc_feature (1)..(2): 2'-deoxy-2'-Fluoro
  misc_feature (4)..(4): 2'-deoxy-2'-Fluoro
  misc_feature (7)..(7): 2'-deoxy-2'-Fluoro
  misc_feature (10)..(10): 2'-deoxy-2'-Fluoro
  misc_feature (15)..(19): 2'-deoxy-2'-Fluoro
  misc_feature (20)..(20): Phosphorothioate or Phosphorodithioate 3'-Internucleotide Linkage
cagugauggugaaauuccutt

SEQ ID NO: 1823 - DNA, 21 bp, Artificial Sequence
  Synthetic siNA antisense region
  misc_feature (1)..(5): 2'-O-Methyl
  misc_feature (13)..(13): 2'-O-Methyl
  misc_feature (16)..(16): 2'-O-Methyl
  misc_feature (19)..(19): 2'-O-Methyl
  misc_feature (6)..(12): 2'-deoxy-2'-Fluoro
  misc_feature (14)..(15): 2'-deoxy-2'-Fluoro
  misc_feature (17)..(18): 2'-deoxy-2'-Fluoro
  misc_feature (20)..(20): Phosphorothioate or Phosphorodithioate 3'-Internucleotide Linkage
  misc_feature (21)..(21): 3'-3 attached terminal glyceryl moiety
aggaauuucaccaucacugtt

SEQ ID NO: 1824 - DNA, 21 bp, Artificial Sequence
  Synthetic siNA sense region
  misc_feature (1)..(1): 2'-O-Methyl or 2'-deoxy-2'-Fluoro
  misc_feature (4)..(4): 2'-O-Methyl or 2'-deoxy-2'-Fluoro
  misc_feature (7)..(7): 2'-O-Methyl or 2'-deoxy-2'-Fluoro
  misc_feature (10)..(10): 2'-O-Methyl or 2'-deoxy-2'-Fluoro
  misc_feature (15)..(19): 2'-O-Methyl or 2'-deoxy-2'-Fluoro
  misc_feature (1)..(1): 5'-3 attached terminal deoxyabasic moiety
  misc_feature (21)..(21): 3'-3 attached terminal deoxyabasic moiety
cagugauggugaaauuccutt

SEQ ID NO: 1825 - DNA, 21 bp, Artificial Sequence
  Synthetic siNA antisense region
  misc_feature (6)..(9): 2'-deoxy-2'-Fluoro
  misc_feature (11)..(12): 2'-deoxy-2'-Fluoro
  misc_feature (14)..(15): 2'-deoxy-2'-Fluoro
  misc_feature (17)..(18): 2'-deoxy-2'-Fluoro
  misc_feature (20)..(20): Phosphorothioate or Phosphorodithioate 3'-Internucleotide Linkage
  misc_feature (21)..(21): 3'-3 attached terminal glyceryl moiety
aggaauuucaccaucacugtt

SEQ ID NO: 1826 - DNA, 21 bp, Artificial Sequence
  Synthetic siNA sense region
  misc_feature (2)..(3): 2'-deoxy
  misc_feature (5)..(6): 2'-deoxy
  misc_feature (8)..(9): 2'-deoxy
  misc_feature (11)..(14): 2'-deoxy
  misc_feature (1)..(1): 2'-deoxy-2'-Fluoro
  misc_feature (4)..(4): 2'-deoxy-2'-Fluoro
  misc_feature (7)..(7): 2'-deoxy-2'-Fluoro
  misc_feature (10)..(10): 2'-deoxy-2'-Fluoro
  misc_feature (15)..(19): 2'-deoxy-2'-Fluoro
  misc_feature (1)..(1): 5'-3 attached terminal deoxyabasic moiety
  misc_feature (21)..(21): 3'-3 attached terminal deoxyabasic moiety
cagugauggugaaauuccutt

SEQ ID NO: 1827 - DNA, 21 bp, Artificial Sequence
  Synthetic siNA sense region
  misc_feature (1)..(1): 2'-deoxy-2'-Fluoro
  misc_feature (4)..(4): 2'-deoxy-2'-Fluoro
  misc_feature (7)..(7): 2'-deoxy-2'-Fluoro
  misc_feature (10)..(10): 2'-deoxy-2'-Fluoro
  misc_feature (15)..(19): 2'-deoxy-2'-Fluoro
  misc_feature (1)..(1): 5'-3 attached terminal deoxyabasic moiety
  misc_feature (21)..(21): 3'-3 attached terminal deoxyabasic moiety
cagugauggugaaauuccutt

SEQ ID NO: 1828 - DNA, 21 bp, Artificial Sequence
  Synthetic siNA antisense region
  misc_feature (1)..(5): 2'-deoxy
  misc_feature (10)..(10): 2'-deoxy
  misc_feature (13)..(13): 2'-deoxy
  misc_feature (16)..(16): 2'-deoxy
  misc_feature (19)..(19): 2'-deoxy
  misc_feature (6)..(9): 2'-deoxy-2'-Fluoro
  misc_feature (11)..(12): 2'-deoxy-2'-Fluoro
  misc_feature (14)..(15): 2'-deoxy-2'-Fluoro
  misc_feature (17)..(18): 2'-deoxy-2'-Fluoro
  misc_feature (20)..(20): Phosphorothioate or Phosphorodithioate 3'-Internucleotide Linkage
  misc_feature (21)..(21): 3'-3 attached terminal glyceryl moiety
aggaauuucaccaucacugtt

SEQ ID NO: 1829 - RNA, 14 nt, Artificial Sequence
  Synthetic Target Sequence/duplex forming oligonucleotide
auauaucuauuucg

SEQ ID NO: 1830 - RNA, 14 nt, Artificial Sequence
  Synthetic Complementary Sequence/duplex forming oligonucleotide
cgaaauagauauau

SEQ ID NO: 1831 - RNA, 23 nt, Artificial Sequence
  Synthetic Self Complementary duplex construct
cgaaaauagauauaucuauuucg

SEQ ID NO: 1832 - DNA, 24 bp, Artificial Sequence
  Synthetic Duplex forming oligonucleotide
  misc_feature (1)..(22): ribonucleotide/modified as described
cgaaauagauauaucuauuucgtt

SEQ ID NO: 1833 - RNA, 3597 nt, Homo sapiens
ggcgaauggagcaggggcgcgcagauaauuaaagauuuacacacagcuggaagaaaucauagagaagccgggcgugguggcucaugccuauaaucccagcacuuuuggaggcugaggcgggcagaucacuugagaucaggaguucgagaccagccuggugccuuggcaucucccaaugggguggcuuugcucugggcuccuguucccugugagcugccugguccugcugcagguggcaagcucugggaacaugaaggucuugcaggagcccaccugcgucuccgacuacaugagcaucucuacuugcgaguggaagaugaauggucccaccaauugcagcaccgagcuccgccuguuguaccagcugguuuuucugcucuccgaagcccacacguguaucccugagaacaacggaggcgcggggugcgugugccaccugcucauggaugacguggucagugcggauaacuauacacuggaccugugggcugggcagcagcugcuguggaagggcuccuucaagcccagcgagcaugugaaacccagggccccaggaaaccugacaguucacaccaaugucuccgacacucugcugcugaccuggagcaacccguaucccccugacaauuaccuguauaaucaucucaccuaugcagucaacauuuggagugaaaacgacccggcagauuucagaaucuauaacgugaccuaccuagaacccucccuccgcaucgcagccagcacccugaagucugggauuuccuacagggcacgggugagggccugggcucagugcuauaacaccaccuggagugaguggagccccagcaccaaguggcacaacuccuacagggagcccuucgagcagcaccuccugcugggcgucagcguuuccugcauugucauccuggccgucugccuguugugcuaugucagcaucaccaagauuaagaaagaauggugggaucagauucccaacccagcccgcagccgccucguggcuauaauaauccaggaugcucaggggucacagugggagaagcggucccgaggccaggaaccagccaagugcccacacuggaagaauugucuuaccaagcucuugcccuguuuucuggagcacaacaugaaaagggaugaagauccucacaaggcugccaaagagaugccuuuccagggcucuggaaaaucagcauggugcccaguggagaucagcaagacaguccucuggccagagagcaucagcguggugcgauguguggaguuguuugaggccccgguggagugugaggaggaggaggagguagaggaagaaaaagggagcuucugugcaucgccugagagcagcagggaugacuuccaggagggaagggagggcauuguggcccggcuaacagagagccuguuccuggaccugcucggagaggagaaugggggcuuuugccagcaggacaugggggagucaugccuucuuccaccuucgggaaguacgagugcucacaugcccugggaugaguucccaagugcagggcccaaggaggcaccucccuggggcaaggagcagccucuccaccuggagccaaguccuccugccagcccgacccagaguccagacaaccugacuugcacagagacgccccucgucaucgcaggcaacccugcuuaccgcagcuucagcaacucccugagccagucaccgugucccagagagcuggguccagacccacugcuggccagacaccuggaggaaguagaacccgagaugcccugugucccccagcucucugagccaaccacugugccccaaccugagccagaaaccugggagcagauccuccgccgaaauguccuccagcauggggcagcugcagcccccgucucggcccccaccaguggcuaucaggaguuuguacaugcgguggagcaggguggcacccaggccagugcgguggugggcuugggucccccaggagaggcugguuacaaggccuucucaagccugcuugccagcagugcuguguccccagagaaauguggguuuggggcuagcaguggggaagagggguauaagccuuuccaagaccucauuccuggcugcccuggggacccugccccagucccuguccccuuguucaccuuuggacuggacagggagccaccucgcaguccgcagagcucacaucucccaagcagcuccccagagcaccugggucuggagccgggggaaaagguagaggacaugccaaagcccccacuuccccaggagcaggccacagacccccuuguggacagccugggcaguggcauugucuacucagcccuuaccugccaccugugcggccaccugaaacagugucauggccaggaggaugguggccagaccccugucauggccaguccuugcuguggcugcugcuguggagacagguccucgcccccuacaaccccccugagggccccagaccccucuccaggugggguuccacuggaggccagucuguguccggccucccuggcacccucgggcaucucagagaagaguaaauccucaucauccuuccauccugccccuggcaaugcucagagcucaagccagacccccaaaaucgugaacuuugucuccgugggacccacauacaugagggucucuuaggugcauguccucuuguugcugagucugcagaugaggacuagggcuuauccaugccugggaaaugccaccuccuggaaggcagccaggcuggcagauuuccaaaagacuugaagaaccaugguaugaaggugauuggccccacugacguuggccuaacacugggcugcagagacuggaccccgcccagcauugggcugggcucgccacaucccaugagaguagagggcacugggucgccgugccccacggcaggccccugcaggaaaacugaggcccuugggcaccucgacuugugaacgaguuguuggcugcucccuccacagcuucugcagcagacugucccuguuguaacugcccaaggcauguuuugcccaccagaucauggcccacguggaggcccaccugccucugucucacugaacuagaagccgagccuagaaacuaacacagccaucaagggaaugacuugggcggccuugggaaaucgaugagaaauugaacuucagggaggguggucauugccuagaggugcucauucauuuaacagagcuuccuuagguugaugcuggaggcagaaucccggcugucaagggguguucaguuaaggggagcaacagaggacaugaaaaauugcuaugacuaaagcagggacaauuugcugccaaacacccaugcccagcuguauggcugggggcuccucguaugcauggaacccccagaauaaauaugcucagccacccugugggccgggcaauccagacagcaggcauaaggcaccaguuacccugcauguuggcccagaccucaggugcuagggaaggcgggaaccuuggguugaguaaugcucgucuguguguuuuaguuucaucaccuguuaucuguguuugcugaggagaguggaacagaagggguggaguuuuguauaaauaaaguuucuuugucuc

The invention claimed is:

1. A chemically modified nucleic acid molecule, wherein:
   (a) the nucleic acid molecule comprises a sense strand having SEQ ID NO:1503 and a separate antisense strand having SEQ ID NO:1511;
   (b) 50 percent or more of the nucleotides in each strand comprise a 2'-sugar modification, wherein the 2'-sugar modification of any of the pyrimidine nucleotides differs from the 2'-sugar modification of any of the purine nucleotides.

2. The nucleic acid molecule of claim 1, wherein the 2'-sugar modification of any of the purine nucleotides in the sense strand differs from the 2'-sugar modification of any of the purine nucleotides in the antisense strand.

3. The nucleic acid molecule of claim 1, wherein the 2'-sugar modification is selected from the group consisting of 2'-deoxy-2'-fluoro, 2'-O-methyl, and 2'-deoxy.

4. The nucleic acid of claim 3, wherein the 2'-deoxy-2'-fluoro sugar modification is a pyrimidine modification.

5. The nucleic acid of claim 3, wherein the 2'-deoxy sugar modification is a pyrimidine modification.

6. The nucleic acid of claim 3, wherein the 2'-O-methyl sugar modification is a pyrimidine modification.

7. The nucleic acid molecule of claim 4, wherein said pyrimidine modification is in the sense strand, the antisense strand, or both the sense strand and antisense strand.

8. The nucleic acid molecule of claim 6, wherein said pyrimidine modification is in the sense strand, the antisense strand, or both the sense strand and antisense strand.

9. The nucleic acid molecule of claim 3, wherein the 2'-deoxy sugar modification is a purine modification.

10. The nucleic acid molecule of claim 3, wherein the 2'-O-methyl sugar modification is a purine modification.

11. The nucleic acid molecule of claim 9, wherein the purine modification is in the sense strand.

12. The nucleic acid molecule of claim 10, wherein the purine modification is in the antisense strand.

13. The nucleic acid molecule of claim 1, wherein the nucleic acid molecule comprises ribonucleotides.

14. The nucleic acid molecule of claim 1, wherein the sense strand includes a terminal cap moiety at the 5'-end, the 3'-end, or both of the 5'- and 3'- ends.

15. The nucleic acid molecule of claim 14, wherein the terminal cap moiety is an inverted deoxy abasic moiety.

16. The nucleic acid molecule of claim 1, wherein said nucleic acid molecule includes one or more phosphorothioate internucleotide linkages.

17. The nucleic acid molecule of claim 16, wherein one of the phosphorothioate internucleotide linkages is at the 3'-end of the antisense strand.

18. The nucleic acid molecule of claim 1, wherein the 5'-end of the antisense strand includes a terminal phosphate group.

19. A composition comprising the nucleic acid molecule of claim 1, in a pharmaceutically acceptable carrier or diluent.

* * * * *